(12) United States Patent
Xu et al.

(10) Patent No.: US 11,845,796 B2
(45) Date of Patent: Dec. 19, 2023

(54) BISPECIFIC POLYPEPTIDE COMPLEXES

(71) Applicant: WUXI BIOLOGICS IRELAND LIMITED, Dundalk (IE)

(72) Inventors: Jianqing Xu, Shanghai (CN); Zhuozhi Wang, Shanghai (CN); Jing Li, Shanghai (CN)

(73) Assignee: WUXI BIOLOGICS IRELAND LIMITED, Mullagharlin (IE)

( * ) Notice: Subject to any disclaimer, the term of this patent is extended or adjusted under 35 U.S.C. 154(b) by 308 days.

(21) Appl. No.: 16/648,995

(22) PCT Filed: Sep. 20, 2018

(86) PCT No.: PCT/CN2018/106766
§ 371 (c)(1),
(2) Date: Mar. 19, 2020

(87) PCT Pub. No.: WO2019/057122
PCT Pub. Date: Mar. 28, 2019

(65) Prior Publication Data
US 2020/0283524 A1 Sep. 10, 2020

(30) Foreign Application Priority Data
Sep. 22, 2017 (WO) ................ PCT/CN2017/103030

(51) Int. Cl.
C07K 16/28 (2006.01)
C12N 15/63 (2006.01)
A61K 39/00 (2006.01)

(52) U.S. Cl.
CPC .......... *C07K 16/2809* (2013.01); *C12N 15/63* (2013.01); *A61K 2039/505* (2013.01); *C07K 2317/31* (2013.01); *C07K 2317/41* (2013.01); *C07K 2317/524* (2013.01); *C07K 2317/526* (2013.01); *C07K 2317/53* (2013.01); *C07K 2317/55* (2013.01); *C07K 2317/56* (2013.01); *C07K 2317/94* (2013.01); *C07K 2319/00* (2013.01)

(58) Field of Classification Search
None
See application file for complete search history.

(56) References Cited

U.S. PATENT DOCUMENTS

| | | | |
|---|---|---|---|
| 5,906,936 A | 5/1999 | Eshhar et al. | |
| 6,335,163 B1 | 1/2002 | Sharon | |
| 7,329,731 B2 | 2/2008 | Jakobsen et al. | |
| 7,381,794 B2 | 6/2008 | Moore et al. | |
| 7,666,604 B2 | 2/2010 | Jakobsen et al. | |
| 7,763,445 B2 | 7/2010 | Moore et al. | |
| 7,763,718 B2 | 7/2010 | Jakobsen et al. | |
| 9,683,052 B2 | 6/2017 | Blein et al. | |
| 9,683,053 B2 | 6/2017 | Blein et al. | |
| 11,203,627 B2* | 12/2021 | Hayes | C07K 14/7051 |
| 2008/0153131 A1 | 6/2008 | Jakobsen et al. | |
| 2010/0047171 A1 | 2/2010 | Beckmann | |
| 2010/0113300 A1 | 5/2010 | Jakobsen et al. | |
| 2015/0183877 A1* | 7/2015 | Demarest | C07K 16/468 435/69.6 |
| 2015/0313977 A1 | 11/2015 | Cohen et al. | |
| 2016/0081314 A1 | 3/2016 | Thurston et al. | |
| 2017/0218043 A1 | 8/2017 | Hayes et al. | |
| 2018/0094077 A1 | 4/2018 | Blein et al. | |
| 2018/0201682 A1 | 7/2018 | Li | |
| 2019/0048080 A1 | 2/2019 | Cai et al. | |
| 2020/0283524 A1 | 9/2020 | Xu et al. | |

FOREIGN PATENT DOCUMENTS

| | | |
|---|---|---|
| CN | 1561343 A | 1/2005 |
| CN | 1714102 A | 12/2005 |
| CN | 1745099 A | 3/2006 |
| CN | 101802015 A | 8/2010 |
| CN | 102574906 A | 7/2012 |
| CN | 105017422 A | 11/2015 |
| CN | 106883298 A | 6/2017 |
| CN | 106922147 A | 7/2017 |

(Continued)

OTHER PUBLICATIONS

Sasada et al (2002) (Involvement of the TCR Cβ FG Loop in Thymic Selection and T Cell Funtion, JEM, vol. 195, 2002) (Year: 2002).*

Wu et al.(2015) (Protein Design of IgG/TCR chimeras for the co-expression of Fab-like moieties within bispecific antibodies, mAbs, vol. 7, 2015) (Year: 2015).*

Degermann et al.(1999) (T-Cell Receptor & Chain Lacking the Large Solvent-exposed Cβ FG Loop Supports Normal α/β T Cell Development and Function in Transgenic Mice, Journal of Experimental Medicine, vol. 189, 1999). (Year: 1999).*

Lunde et al (Stabilizing mutations increase secretion of functional soluble TCR-Ig fusion proteins, BMC Biotechnology, vol. 10, 2010) (Year: 2010).*

Boutler et al (Stable, soluble T-cell receptor molecules for crystallization and therapeutics, vol. 16, pp. 707-711, 2003). (Year: 2003).*

Sasada et al (2002) (Involvement of the TCR C& FG Loop in Thymic Selection and T Cell Function, JEM, vol. 195, 2002 (Year: 2002).*

(Continued)

*Primary Examiner* — Laura B Goddard
*Assistant Examiner* — Sarah A Alsomairy
(74) *Attorney, Agent, or Firm* — FINNEGAN, HENDERSON, FARABOW, GARRETT & DUNNER LLP

(57) ABSTRACT

A polypeptide complex comprises antibody variable regions of the heavy chain and light chain respectively fused to TCR constant regions. A bispecific antigen binding polypeptide complex contains a first antigen-binding moiety of the polypeptide complex and a second antigen-binding moiety. A method comprises producing the polypeptide complex or the bispecific antigen binding polypeptide complex. A method of treating disease or disorder comprises using the polypeptide complex or the bispecific antigen binding polypeptide complex. A polynucleotide encodes the polypeptide complex and/or the bispecific antigen binding polypeptide complex. A vector or a host cell contains the polynucleotide. A composition and a pharmaceutical composition comprise the polypeptide complex and/or the bispecific antigen binding polypeptide complex.

27 Claims, 85 Drawing Sheets

Specification includes a Sequence Listing.

(56) References Cited

FOREIGN PATENT DOCUMENTS

| | | | |
|---|---|---|---|
| CN | 107072184 A | 8/2017 | |
| CN | 107614519 A | 1/2018 | |
| CN | 103608357 B | 3/2018 | |
| CN | 104829726 A | 8/2018 | |
| EP | 1732946 B1 | 7/2011 | |
| JP | H1169975 | 3/1999 | |
| JP | 2005/514006 A | 5/2005 | |
| JP | 2008/520223 A | 6/2008 | |
| WO | WO 89/03996 A1 | 5/1989 | |
| WO | WO 2003/020763 A2 | 3/2003 | |
| WO | WO 2004/044004 A2 | 5/2004 | |
| WO | WO 2007/085814 A1 | 8/2004 | |
| WO | WO 2004/074322 A1 | 9/2004 | |
| WO | WO 2005/113595 A2 | 12/2005 | |
| WO | WO 2006/054096 A1 | 5/2006 | |
| WO | WO 2006/056733 A1 | 6/2006 | |
| WO | WO 2008/119353 A1 | 10/2008 | |
| WO | WO 2011/001152 A1 | 1/2011 | |
| WO | WO 2013/041865 A1 | 3/2013 | |
| WO | WO 2014/014796 A1 | 1/2014 | |
| WO | WO-2014014796 A1 * | 1/2014 | ......... C07K 14/7051 |
| WO | WO 2016/033570 A1 | 3/2016 | |
| WO | WO 2016/044745 A1 | 3/2016 | |
| WO | WO 2016/048938 A1 | 3/2016 | |
| WO | WO 2016/070061 A1 | 5/2016 | |
| WO | WO 2016/097408 A1 | 6/2016 | |
| WO | WO 2016/184258 A1 | 11/2016 | |
| WO | WO 2017/027392 A1 | 2/2017 | |
| WO | WO 2017/053469 A2 | 3/2017 | |
| WO | WO 2017/055314 A1 | 4/2017 | |
| WO | WO 2017/059900 A1 | 4/2017 | |
| WO | WO 2017/060300 A1 | 4/2017 | |
| WO | WO 2017/070608 A1 | 4/2017 | |
| WO | WO 2017/112944 A1 | 6/2017 | |
| WO | WO 2017/192536 A1 | 11/2017 | |
| WO | WO-2018175585 A2 * | 9/2018 | ............ A61K 39/00 |
| WO | WO 2019/057099 A1 | 3/2019 | |
| WO | WO 2019/057122 A1 | 3/2019 | |

OTHER PUBLICATIONS

Noelle V. Frey, et al., "Cytokine release syndrome with novel therapeutics for acute lymphoblastic leukemia," *Hematology*, pp. 567-572 (2016).
Hagop Kantarjian, et al., "Blinatumomab versus Chemotherapy for Advanced Acute Lymphoblastic Leukemia," *The New England Journal of Medicine*, vol. 376, pp. 836-847 (2017).
Extended European Search Report for European App. No. 18857563. 3, dated May 11, 2021 (ten pages).
Emma S. Hickman, "Antigen Selection for Enhanced Affinity T-Cell Receptor-Based Cancer Therapies", *Journal of Biomolecular Screening for Laboratory Automation and Screening*, pp. 769-785 (2016).
Ulrich Weidle et al., "TCR-MHC/Peptide Interaction: Prospects for New Anti-tumoral Agents", *Cancer Genomics & Proteomics*, vol. 11, pp. 267-278 (2014).
"IMGT/3Dstructure-DB card for 2p5e", IMGT.org, Apr. 26, 2021, http://www.imgt.com/3Dstructure-DB/cgi/details.cgi?pbcode=2p5e.
J. Kuball et al., "Facilitating matched pairing and expression of TCR chains introduced into human T cells", *Blood*, vol. 109, No. 6, pp. 2331-2338 (2007).
T. T. Juntilla et al., "Antitumor Efficacy of a Bispecific Antibody That Targets HER2 and Activities T Cells", *Cancer Research*, vol. 74, No. 19, pp. 5561-5571 (2014).

Chinese Office Action issued in Application No. 201811100222.5 from The State Intellectual Property Office of People's Republic of China dated Mar. 19, 2020 (9 pages) and its translation from Global Dossier (7 pages).
Bialer, G. et al. "Selected Murine Residues Endow Human TCR with Enhanced Tumor Recognition," J Immunol, 184, 6232-6241, 2010.
Boulter, J.M. et al. "Stable, soluble T-cell receptor molecules for crystallization and therapeutics," Protein Engineering, vol. 16, No. 9, pp. 707-711, 2003.
Eshhar, Z. et al. "Specific activation and targeting of cytotoxic lymphocytes through chimeric single chains consisting of antibody-binding domains and the γ or ζ subunits of the immunoglobulin and T-cell receptors," Proc. Natl. Acad. Sci., USA, 1993, No. 2(90), pp. 720-724.
Goverman, J. et al. "Chimeric Immunoglobulin-T Cell Receptor Proteins Form Functional Receptors: Implications for T Cell Receptor Complex Formation and Activation," Cell, 1990, vol. 60, pp. 929-939.
Huehls, A.M. et al. "Bispecific T cell engagers for cancer immunotherapy," *Immunol Cell Biol.*, Mar. 2015, 93(3), pp. 290-296, doi:10.1038/icb.2014.93.
International Search Report and Written Opinion, issued in PCT/CN2018/106776, dated Dec. 27, 2018, 15 pages.
Kipriyanov, S.M. et al. "Bispecific CD3 XCDL 9 diabody fort cell-mediated lysis of malignant human B cells," Int. J. Cancer, 1998, No. 5(77), pp. 763-772.
Sommermeyer, D. et al. "Minimal Amino Acid Exchange in Human TCR Constant Regions Fosters Improved Function of TCR Gene-Modified T Cells," J Immunol, 184, 6223-6231, 2010.
Wagner, E.K. et al. "Human cytomegalovirus-specific T-cell receptor engineered for high affinity and soluble expression using mammalian cell display," J. Biol. Chem. (2019) 294(15) 5790-5804.
Wu et al. "Blinatumomab: A bispecific T cell engager (BiTE) antibody against CD 19/CD3 for refractory acute lymphoid leukemia," Journal of Hematology & Oncology, 2015, vol. 8, pp. 1-7.
Wu et al. "Protein design of IgG/TCR chimeras for the coexpression of Fab-like moieties within bispecific antibodies," mAbs, 2015, 7(2):364-376.
International Search Report and Written Opinion, issued in PCT/CN2018/106766, dated Dec. 11, 2018, 13 pages.
Spiess et al., "Alternative molecular formats and therapeutic applications for bispecific antibodies," Molecular Immunology, 2015, 67, 95-106.
Seimiya et al., "T cell receptor-extracellular constant regions as hetero-cross-linkers for immunoglobulin variable regions," J. Biochem, 1993, 113, 687-691.
Degermann et al., "T cell receptor beta chain lacking the large solvent-exposed Cbeta FG loop supports normal alpha/beta T cell development and function in transgenic mice," J Exp Med. 1999;189(10):1679-1683.
Sasada et al., "Involvement of the TCR Cbeta FG loop in thymic selection and T cell function," J Exp Med. 2002;195(11):1419-1431.
X. Wu, et al., "protein design of IgG/TCR chimeras for the co-expression of Fab-like moieties within bispecific antibodies," *mAbs*, 7:2, pp. 364-376 (Mar./Apr. 2015), https://doi.org/10.1080/19420862.2015.1007826.
US 2019/048080 A1 as an English language counterpart of listed CN 106883298 A.
WO 2016/033570 A1 as an English language counterpart of listed CN 106922147 A.
WO 2011/001152 A1 as an English language counterpart of listed CN 102574906 A.
WO 2008/119353 A1 as an English language counterpart of listed CN 101802015 A.

* cited by examiner

FIG. 2C

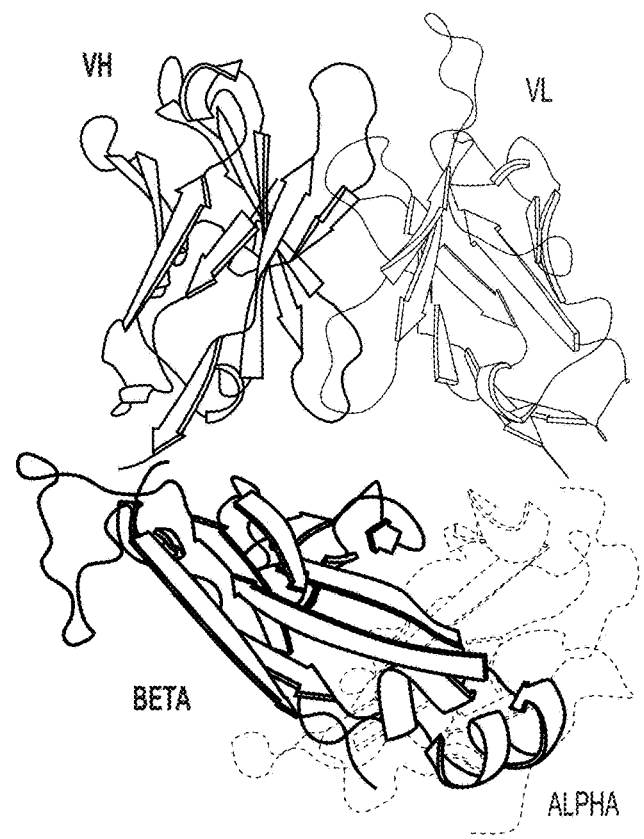
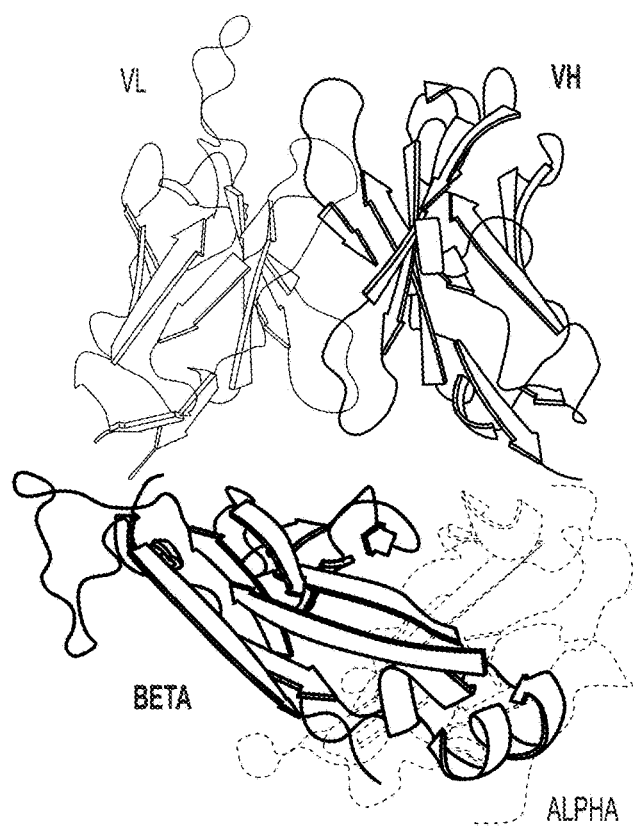
FIG. 2D

Constant region sequence of TCR alpha chain:

```
TRAC_Human        PNIQNPDPAV YQLRDSKSSD KSVCLFTDFD SQTNVSQSKD SDVYITDKTV
4L4T_Alpha_Crystal PDIQNPDPAV YQLRDSKSSD KSVCLFTDFD SQTNVSQSKD SDVYITDKCV TRAC_Human        LDMRSMDFKS NSAVAWSNKS DFACANAFNN SIIPEDTFFP SPESSCDVKL
4L4T_Alpha_Crystal LDMRSMDFKS NSAVAWSNKS DFACANAFNN SIIPEDTFFP SPESS------

TRAC_Human        VEKSFETDTN LNFQNLSVIG FRILLLKVAG FNLLMTLRLW SS  SEQ ID NO:254
4L4T_Alpha_Crystal ---------- ---------- ---------- ---------- --  SEQ ID NO:255
```

FIG. 18A

Constant region sequence of TCR beta chain:

```
TRBC1_Human      EDLKNVFPPE VAVFEPSEAE ISHTQKATLV CLATGFFPDH VELSWWVNGK
TRBC2_Human      -DLKNVFPPE VAVFEPSEAE ISHTQKATLV CLATGFYPDH VELSWWVNGK
4L4T_Beta_Crystal EDLKNVFPPE VAVFEPSEAE ISHTQKATLV CLATGFYPDH VELSWWVNGK TRBC1_Human      EVHSGVSTDP QPLKEQPALN DSRYCLSSRL RVSATFWQNP RNHFRCQVQF
TRBC2_Human      EVHSGVSTDP QPLKEQPALN DSRYCLSSRL RVSATFWQNP RNHFRCQVQF
4L4T_Beta_Crystal EVHSGVCTDP QPLKEQPALN DSRYALSSRL RVSATFWQNP RNHFRCQVQF TRBC1_Human      YGLSENDEWT QDRAKPVTQI VSAEAWGRAD CGFTSVSYQQ GVLSATILYE
TRBC2_Human      YGLSENDEWT QDRAKPVTQI VSAEAWGRAD CGFTSESYQQ GVLSATILYE
4L4T_Beta_Crystal YGLSENDEWT QDRAKPVTQI VSAEAWGRAD ---------- ----------

TRBC1_Human      ILLGKATLYA VLVSALVLMA MVKRKDF--    SEQ ID NO:256
TRBC2_Human      ILLGKATLYA VLVSALVLMA MVKRKDSRG    SEQ ID NO:257
4L4T_Beta_Crystal ---------- ---------- ---------    SEQ ID NO:258
```

FIG. 18B

Constant region sequence of pre-alpha:

```
          PTCRA_HUMAN  MAGTWLLLLL ALGCPALPTG VGGTPFPPSLA PPTMLLVDGK QQMVVVCLVL
    30F6_PreAlpha_Crystal  ---------- ---GAHMLPTG VGGTPFPPSLA PPTMLLVDGK QQMVVVCLVL PTCRA_HUMAN  DVAPPGLDSP IWFSAGNGSA LDAFTYGPSP ATDGTWTNLA HLSLPSEELA
    30F6_PreAlpha_Crystal  DVAPPGLDSP IWFSAGNGSA LDAFTYGPSP ATDGTWTNLA HLSLPSEELA PTCRA_HUMAN  SWEPIVCHTG PGAEGISRST QPMHLSGEAS TARTCPQEPL RGTPGGALWL
    30F6_PreAlpha_Crystal  SWEPIVCHTG PGAEGISRST QPMHLSGEAS TARTC-SGDD DDK-------

PTCRA_HUMAN  GVLRLLLFKL LLFDLLLTCS CLCDPAGPLP SPATTTRLRA LGSHRLHPAT
    30F6_PreAlpha_Crystal  ---------- ---------- ---------- ---------- ----------

PTCRA_HUMAN  ETGGREATSS PRPQPRDRRW GDTPPGRKPG SPVWGEGSYL SSYPTCPAQA
    30F6_PreAlpha_Crystal  ---------- ---------- ---------- ---------- ----------

PTCRA_HUMAN  WCSRSALRAP SSSLGAFFAG DLPPPLQAGA A       SEQ ID NO:259
    30F6_PreAlpha_Crystal  ---------- ---------- ---------- -       SEQ ID NO:260
```

FIG. 18C

Constant region sequence of delta:

```
         TRA@_Human   MLFSSLLCVF VAFSYSGSSV AQKVTQAQSS VSMPVRKAVT LNCLYETSWW
4LFH_Delta_Crystal   ---------- -------ETG AQKVTQAQSS VSMPVRKAVT LNCLYETSWW TRA@_Human   SYYIFWYKQL PSKEMIFLIR QGSDEQNAKS GRYSVNFKKA AKSVALTISA
4LFH_Delta_Crystal   SYYIFWYKQL PSKEMIFLIR QGSDEQNAKS GRYSVNFKKA AKSVALTISA TRA@_Human   LQLEDSAKYF CALGESFLPF RGNFHYTIDKL IFGKGTRVTV EPRSQPHTKP
4LFH_Delta_Crystal   LQLEDSAKYF CALGD----- --PGGLNTDKL IFGKGTRVTV EPRSQPHTKP TRA@_Human   SVFVMKNGTN VACLVKEFYP KDIRINLVSS KKITEFDPAI VISPSGKYNA
4LFH_Delta_Crystal   SVFVMKNGTN VACLVKEFYP KDIRINLVSS KKITEFDPAI VISPSGKYNA TRA@_Human   VKLGKYEDSN SVTCSVQHDN KTVHSTDFEV KTDSTDHVKP KETENTKQPS
4LFH_Delta_Crystal   VKLGKYEDSN SVTCSVQHDN KTVHSTDFEV KTDSTDHVKP KETENTKQPS TRA@_Human   K--SCHKPKA IVHTEKVNMM SLTVLGLRML FAKTVAVNFL LTAKLFFL    SEQ ID NO:261
4LFH_Delta_Crystal   KSASGLVPR- ---------- ---------- ---------- --------    SEQ ID NO:262
```

FIG. 18D

Constant region sequence of gamma:

```
TRGC1_Human          DKQLDADVSP KPTIFLPSIA ETKLQKAGTY LCLLEKFFPD VIKIHWQEKK
4LFH_Gamma_Crystal   DKQLDADVSP KPTIFLPSIA ETKLQKAGTY LCLLEKFFPD VIKIHWQEKK
TRGC2_Human          DKQLDADVSP KPTIFLPSIA ETKLQKAGTY LCLLEKFFPD IIKIHWQEKK TRGC1_Human          SNTILGSQEG NTMKTNDTYM KFSWLTVPEK SLDKEHRCIV RHENNKNGVD
4LFH_Gamma_Crystal   SNTILGSQEG NTMKTNDTYM KFSWLTVPEE SLDKEHRCIV RHENNKNGVD
TRGC2_Human          SNTILGSQEG NTMKTNDTYM KFSWLTVPEE SLDKEHRCIV RHENNKNGID TRGC1_Human          QEIIFPPIKT DVITMDPKD- ---------- ---NCSKD    ANDTLLLQLT
4LFH_Gamma_Crystal   QEIIFPPIKT DVITMDPKD- ---------- -------N    ----------
TRGC2_Human          QEIIFPPIKT DVTTVDPKDS YSKDANDVIT MDPKDNWSKD ANDTLLLQLT TRGC1_Human          NTSAYYMYLL LLLKSVVYFA IITCCLLRRT AFCCNGEKS   SEQ ID NO:263
4LFH_Gamma_Crystal   -ASG------ ---------- ---------- ---LVPR--   SEQ ID NO:264
TRGC2_Human          NTSAYYMYLL LLLKSVVYFA IITCCLLGRT AFCCNGEKS   SEQ ID NO:265
```

FIG. 18E

Numbering Defined for Alpha Constant Region:

|  | 1 | 11 | 21 | 31 | 50 |
|---|---|---|---|---|---|
| TRAC_Human | PNIQNPDPAV | YQLRDSKSSD | KSVCLFTDFD | SQTNVSQSKD | SDVYITDKTV |
| 4L4T_Alpha_Crystal | PDIQNPDPAV | YQLRDSKSSD | KSVCLFTDFD | SQTNVSQSKD | SDVYITDKCV |
| E17_Design_2_QQQQ_IgG4 | PDIQNPDPAV | YQLRDSKSSD | KSVCLFTDFD | SQTQVSQSKD | SDVYITDKCV |

|  | 51 | 61 | 71 | 81 | 95 | SEQ ID NO: |
|---|---|---|---|---|---|---|
| TRAC_Human | LDMRSMDFKS | NSAVAWSNKS | DFACANAFNN | SIIPEDTFFP | SPESS | 239 |
| 4L4T_Alpha_Crystal | LDMRSMDFKS | NSAVAWSNKS | DFACANAFNN | SIIPEDTFFP | SPESS | 240 |
| E17_Design_2_QQQQ_IgG4 | LDMRSMDFKS | NSAVAWSQKS | DFACANAFQN | SIIPEDTFFP | SPESS | 241 |

FIG. 19A

Numbering Defined for Beta Constant Region:

|  | 0 1 | 11 | 21 | 31 | | 50 |
|---|---|---|---|---|---|---|
| TRBC1_Human | E DLNKVFPPEV | AVFEPSEAEI | SHTQKATLVC | LATGFFPDHV | ELSWWVNGKE | |
| 4L4T_Beta_Crystal | LE DLKNVFPPEV | AVFEPSEAEI | SHTQKATLVC | LATGFYPDHV | ELSWWVNGKE | |
| E17_Design_2_QQQQ_IgG4 | LE DLKNVFPPEV | AVFEPSEAEI | SHTQKATLVC | LATGFYPDHV | ELSWWVNGKE | |

|  | 51 | 61 | 71 | 81 | | 100 |
|---|---|---|---|---|---|---|
| TRBC1_Human | VHSGVSTDPQ | PLKEQPALND | SRYCLSSRLR | VSATFWQNPR | NHFRCQVQFY | |
| 4L4T_Beta_Crystal | VHSGVCTDPQ | PLKEQPALND | SRYALSSRLR | VSATFWQNPR | NHFRCQVQFY | |
| E17_Design_2_QQQQ_IgG4 | VHSGVCTDPQ | PLKEQPALQD | SRYALSSRLR | VSATFWQNPR | NHFRCQVQFY | |

|  | 101 | 111 | 124 | 128 | SEQ ID NO: |
|---|---|---|---|---|---|
| TRBC1_Human | GLSENDEWTQ | DRAKPVTQIV | SAEA | WGRA | 242 |
| 4L4T_Beta_Crystal | GLSENDEWTQ | DRAKPVTQIV | SAEA | WGRA | 243 |
| E17_Design_2_QQQQ_IgG4 | GLSENDEWTQ | DRAKPVTQIV | SAEA | WGRA | 244 |

FIG. 19B

Numbering Defined for Pre-Alpha Constant Region:

```
                                          1           11          21          31          41          50
                            PTCRA_Human   PTGVGGTPFP  SLAPPIMLLV  DGKQQMVVVC  LVLDVAPPGL  DSPIWFSAGN
                   3OF6_PreAlpha_Crystal  PTGVGGTPFP  SLAPPIMLLV  DGKQQMVVVC  LVLDVAPPGL  DSPIWFSAGN
Design_6_Pre_TCR_Construction'_1_Cys14    PTGVGGTPFP  CLAPPIMLLV  DGKQQMVVVC  LVLDVAPPGL  DSPIWFSAGQ 51          61          71          81          91          100
                            PTCRA_Human   GSALDAFTYG  PSPATDGTWT  NLAHLSLPSE  ELASWEPLVC  HTGPGAEGHS
                   3OF6_PreAlpha_Crystal  GSALDAFTYG  PSPATDGTWT  NLAHLSLPSE  ELASWEPLVC  HTGPGAEGHS
Design_6_Pre_TCR_Construction'_1_Cys14    GSALDAFTYG  PSPATDGTWT  NLAHLSLPSE  ELASWEPLVC  HTGPGAEGHS 101         117  SEQ ID NO:
                            PTCRA_Human   RSTQPMHLSG  EASTART   245
                   3OF6_PreAlpha_Crystal  RSTQPMHLSG  EASTART   246
Design_6_Pre_TCR_Construction'_1_Cys14    RSTQPMHLSG  EASTART   247
```

FIG. 19C

Numbering Defined for Delta Constant Region:

```
                         0 1         11          21          31          50
         TRA@_Human      E PRSQPHTKPS VFVMKNGTNV ACLVKEFYPK DIRINLVSSK KITEFDPAIV
 4LFH_Delta_Crystal      E PRSQPHTKPS VFVMKNGTNV ACLVKEFYPK DIRINLVSSK KITEFDPAIV
Design_2_Cys5_no_Glyco   E PRSQPHTKPS VFVMKQGTNV ACLVKEFYPK DIRINLVSSK KITEFDPAIV 51          61          71                    88  SEQ ID NO:
         TRA@_Human      ISPSGKYNAV KLGKYEDSNS VTCSVQHDNK TVHSTDFE          248
 4LFH_Delta_Crystal      ISPSGKYNAV KLGKYEDSNS VTCSVQHDNK TVHSTDFE          249
Design_2_Cys5_no_Glyco   ISPSGKYNAV KLGKYEDSNS VTCSVQHDQK TVHSTDFC          250
```

*FIG. 19D*

Numbering Defined for Gamma Constant Region:

```
                              0    1           11          21          31          50
         TRGC1_Human          TD KQLDADVSPK PTIFLPSIAE TKLQKAGTYL CLLEKFFPDV IKIHWQEKKS
   4LFH_Gamma_Crystal         TD KQLDADVSPK PTIFLPSIAE TKLQKAGTYL CLLEKFFPDV IKIHWQEKKS
Design_2_Cys5_no_Glyco        TD KQLDADVSPK PTIFLPSICE TKLQKAGTYL CLLEKFFPDV IKIHWQEKKS 51         61          71          81          100
         TRGC1_Human          NTILGSQEGN TMKTNDTYMK FSWLTVPEKS LDKEHRCIVR HENNKNGVDQ
   4LFH_Gamma_Crystal         NTILGSQEGN TMKTNDTYMK FSWLTVPEES LDKEHRCIVR HENNKNGVDQ
Design_2_Cys5_no_Glyco        NTILGSQEGN TMKTQDTYMK FSWLTVPEES LDKEHRCIVR HENNKNGVDQ 101  SEQ ID NO:
         TRGC1_Human          EIIF  251
   4LFH_Gamma_Crystal         EIIF  252
Design_2_Cys5_no_Glyco        EIIF  253
```

FIG. 19E

Positions of IgG1 "knob" mutations

```
               1                                                          50
IgG1_wild      EPKSCDKTHT CPPCPAPELL GGPSVFLFPP KPKDTLMISR TPEVTCVVVD
IgG1_Knob      EPKSCDKTHT CPPCPAPELL GGPSVFLFPP KPKDTLMISR TPEVTCVVVD 51                                                         100
IgG1_wild      VSHEDPEVKF NWYVDGVEVH NAKTKPREEQ YNSTYRVVSV LTVLHQDWLN
IgG1_Knob      VSHEDPEVKF NWYVDGVEVH NAKTKPREEQ YNSTYRVVSV LTVLHQDWLN 101                                                        150
IgG1_wild      GKEYKCKVSN KALPAPIEKT ISKAKGQPRE PQVYTLPPSR EEMTKNQVSL
IgG1_Knob      GKEYKCKVSN KALPAPIEKT ISKAKGQPRE PQVYTLPPCR EEMTKNQVSL 151                                                        200
IgG1_wild      TCLVKGFYPS DIAVEWESNG QPENNYKTTP PVLDSDGSFF LYSKLTVDKS
IgG1_Knob      WCLVKGFYPS DIAVEWESNG QPENNYKTTP PVLDSDGSFF LYSKLTVDKS 201                                 232       SEQ ID NO:
IgG1_wild      RWQQGNVFSC SVMHEALHNH YTQKSLSLSP GK             294
IgG1_Knob      RWQQGNVFSC SVMHEALHNH YTQKSLSLSP GK             295
```

FIG. 20A

Positions of IgG4 "knob" mutations

```
               1                                                          50
IgG4_wild      ESKYGPPCPP CPAPEFLGGP SVFLFPPKPK DTLMISRTPE VTCVVVDVSQ
IgG4_Knob      ESKYGPPCPP CPAPEFLGGP SVFLFPPKPK DTLMISRTPE VTCVVVDVSQ 51                                                         100
IgG4_wild      EDPEVQFNWY VDGVEVHNAK TKPREEQFNS TYRVVSVLTV LHQDWLNGKE
IgG4_Knob      EDPEVQFNWY VDGVEVHNAK TKPREEQFNS TYRVVSVLTV LHQDWLNGKE 101                                                        150
IgG4_wild      YKCKVSNKGL PSSIEKTISK AKGQPREPQV YTLPPSQEEM TKNQVSLTCL
IgG4_Knob      YKCKVSNKGL PSSIEKTISK AKGQPREPQV YTLPPCQEEM TKNQVSLWCL 151                                                        200
IgG4_wild      VKGFYPSDIA VEWESNGQPE NNYKTTPPVL DSDGSFFLYS RLTVDKSRWQ
IgG4_Knob      VKGFYPSDIA VEWESNGQPE NNYKTTPPVL DSDGSFFLYS RLTVDKSRWQ 201                            229       SEQ ID NO:
IgG4_wild      EGNVFSCSVM HEALHNHYTQ KSLSLSLGK            297
IgG4_Knob      EGNVFSCSVM HEALHNHYTQ KSLSLSLGK            298
```

FIG. 20B

Positions of IgG1 "hole" mutations

```
                 1                                                                    50
IgG1_wild        EPKSCDKTHT CPPCPAPELL GGPSVFLFPP KPKDTLMISR TPEVTCVVVD
IgG1_Hole        EPKSCDKTHT CPPCPAPELL GGPSVFLFPP KPKDTLMISR TPEVTCVVVD 51                                                                   100
IgG1_wild        VSHEDPEVKF NWYVDGVEVH NAKTKPREEQ YNSTYRVVSV LTVLHQDWLN
IgG1_Hole        VSHEDPEVKF NWYVDGVEVH NAKTKPREEQ YNSTYRVVSV LTVLHQDWLN 101                                                                   150
IgG1_wild        GKEYKCKVSN KALPAPIEKT ISKAKGQPRE PQVYTLPPSR EEMTKNQVSL
IgG1_Hole        GKEYKCKVSN KALPAPIEKT ISKAKGQPRE PQVCTLPPSR EEMTKNQVSL 151                                                                   200
IgG1_wild        TCLVKGFYPS DIAVEWESNG QPENNYKTTP PVLDSDGSFF LYSKLTVDKS
IgG1_Hole        SCAVKGFYPS DIAVEWESNG QPENNYKTTP PVLDSDGSFF LVSKLTVDKS 201                     232           SEQ ID NO:
IgG1_wild        RWQQGNVFSC SVMHEALHNH YTQKSLSLSP GK       294
IgG1_Hole        RWQQGNVFSC SVMHEALHNH YTQKSLSLSP GK       296
```

FIG. 20C

Positions of IgG4 "hole" mutations

```
                1                                                           50
IgG4_wild       ESKYGPPCPP CPAPEFLGGP SVFLFPPKPK DTLMISRTPE VTCVVVDVSQ
IgG4_Hole       ESKYGPPCPP CPAPEFLGGP SVFLFPPKPK DTLMISRTPE VTCVVVDVSQ 51                                                          100
IgG4_wild       EDPEVQFNWY VDGVEVHNAK TKPREEQFNS TYRVVSVLTV LHQDWLNGKE
IgG4_Hole       EDPEVQFNWY VDGVEVHNAK TKPREEQFNS TYRVVSVLTV LHQDWLNGKE 101                                                         150
IgG4_wild       YKCKVSNKGL PSSIEKTISK AKGQPREPQV YTLPPSQEEM TKNQVSLTCL
IgG4_Hole       YKCKVSNKGL PSSIEKTISK AKGQPREPQV CTLPPSQEEM TKNQVSLSCA 151                                                         200
IgG4_wild       VKGFYPSDIA VEWESNGQPE NNYKTTPPVL DSDGSFFLYS RLTVDKSRWQ
IgG4_Hole       VKGFYPSDIA VEWESNGQPE NNYKTTPPVL DSDGSFFLVS RLTVDKSRWQ 201                    229              SEQ ID NO:
IgG4_wild       EGNVFSCSVM HEALHNHYTQ KSLSLSLGK          297
IgG4_Hole       EGNVFSCSVM HEALHNHYTQ KSLSLSLGK          299
```

FIG. 20D

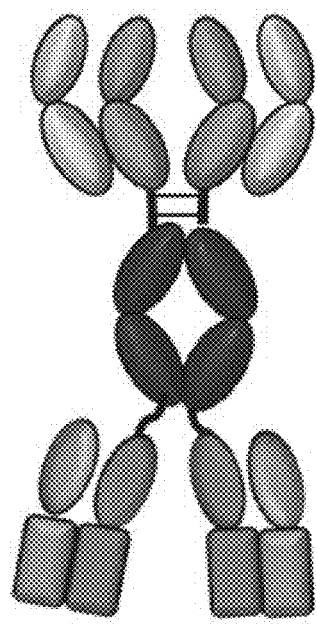 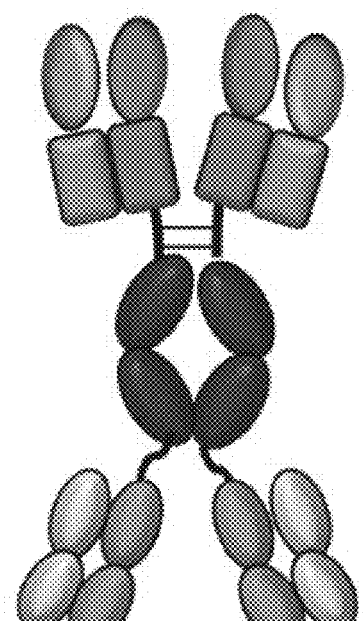 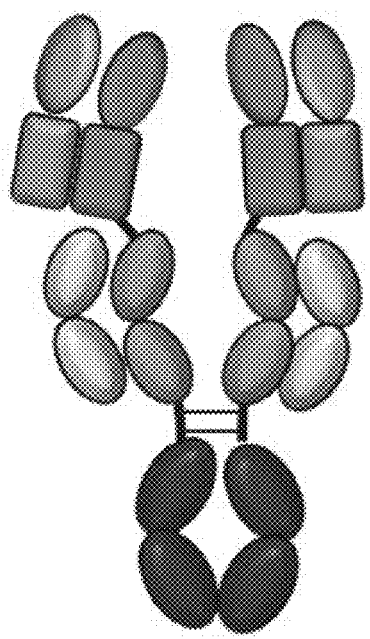 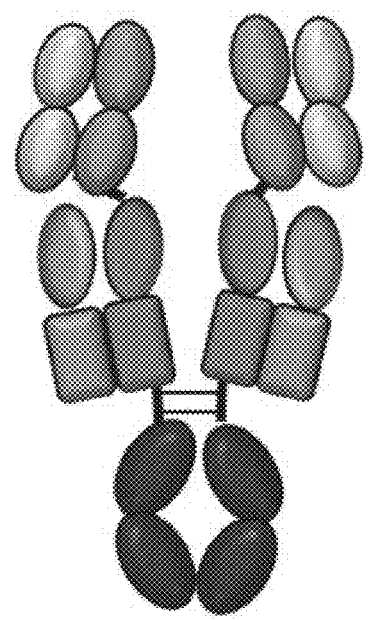
FIG. 22

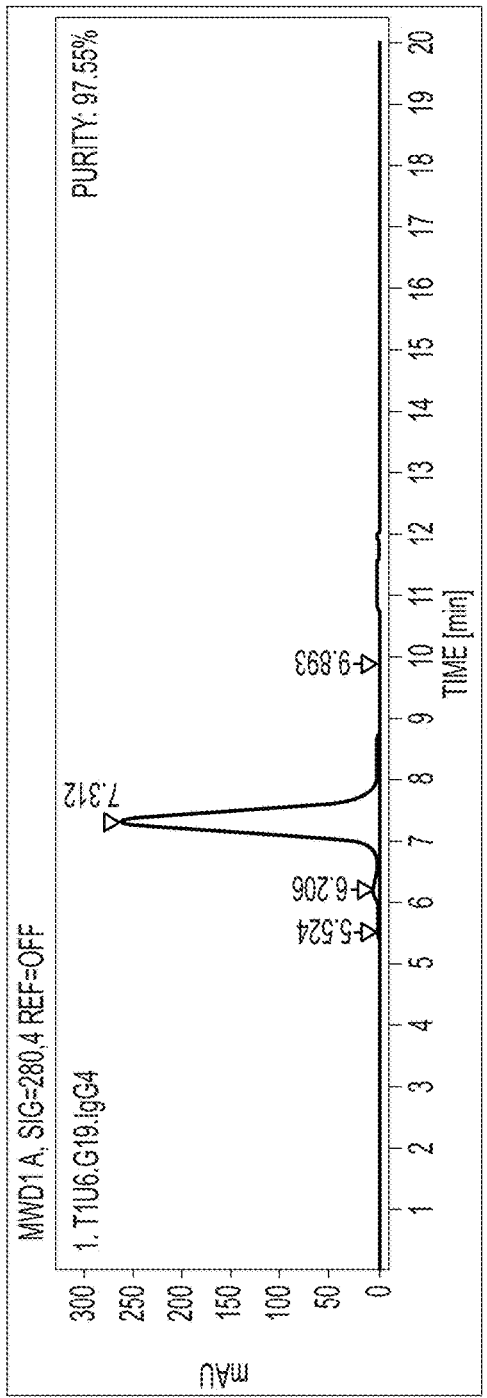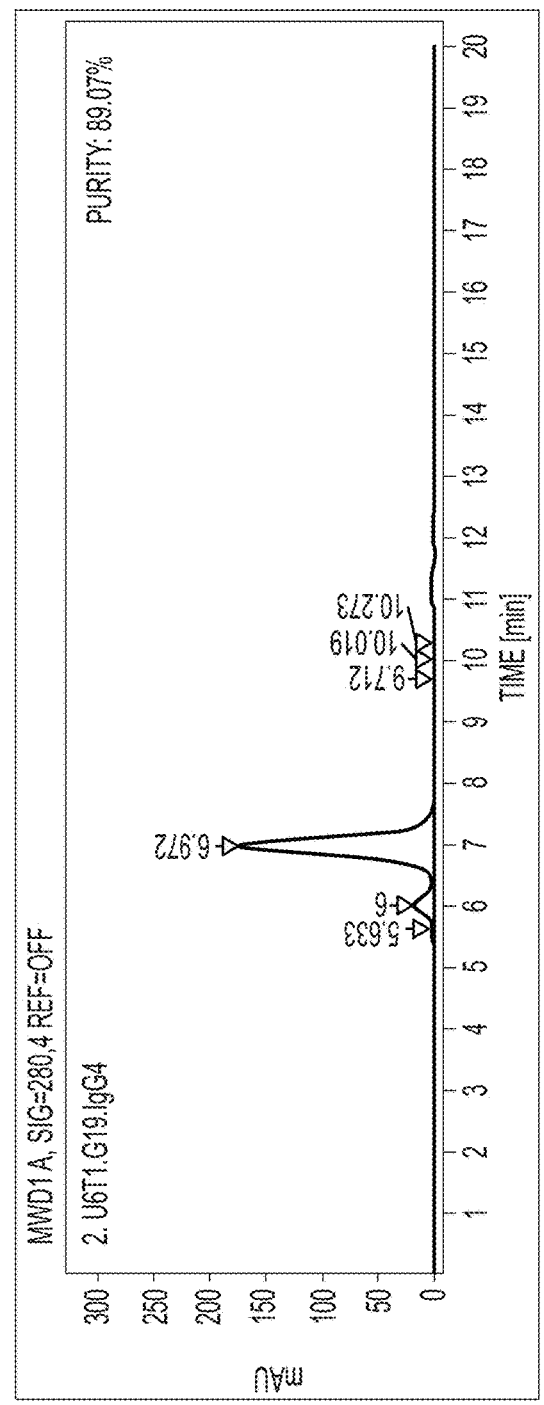
FIG. 23B

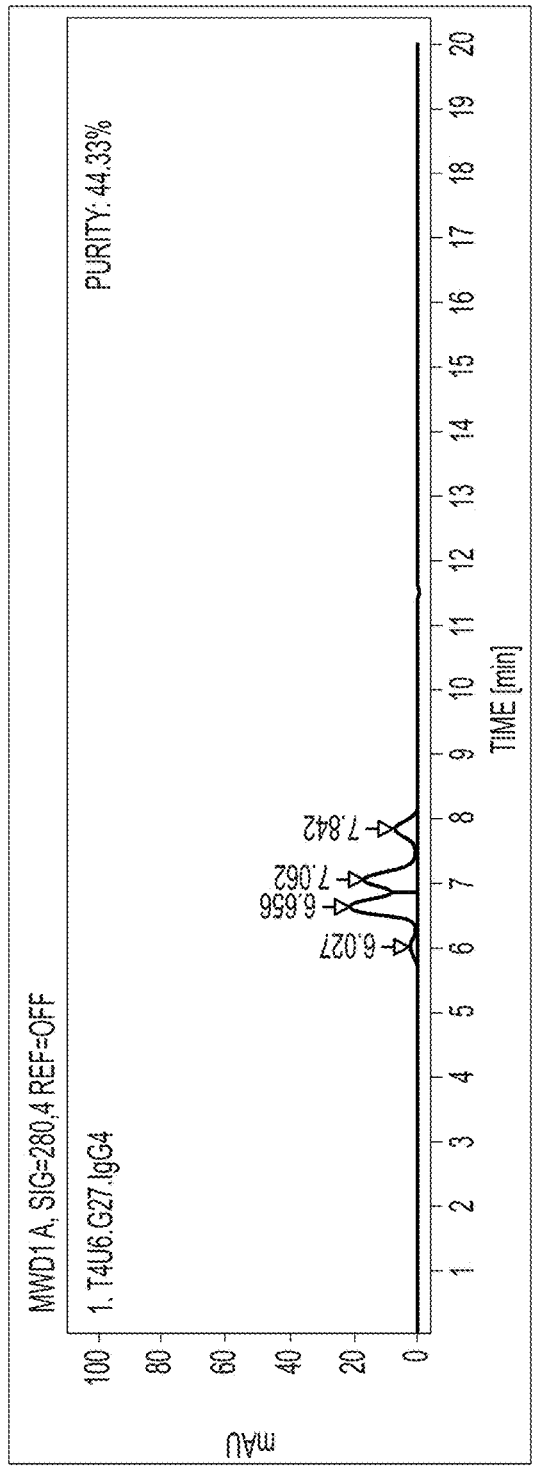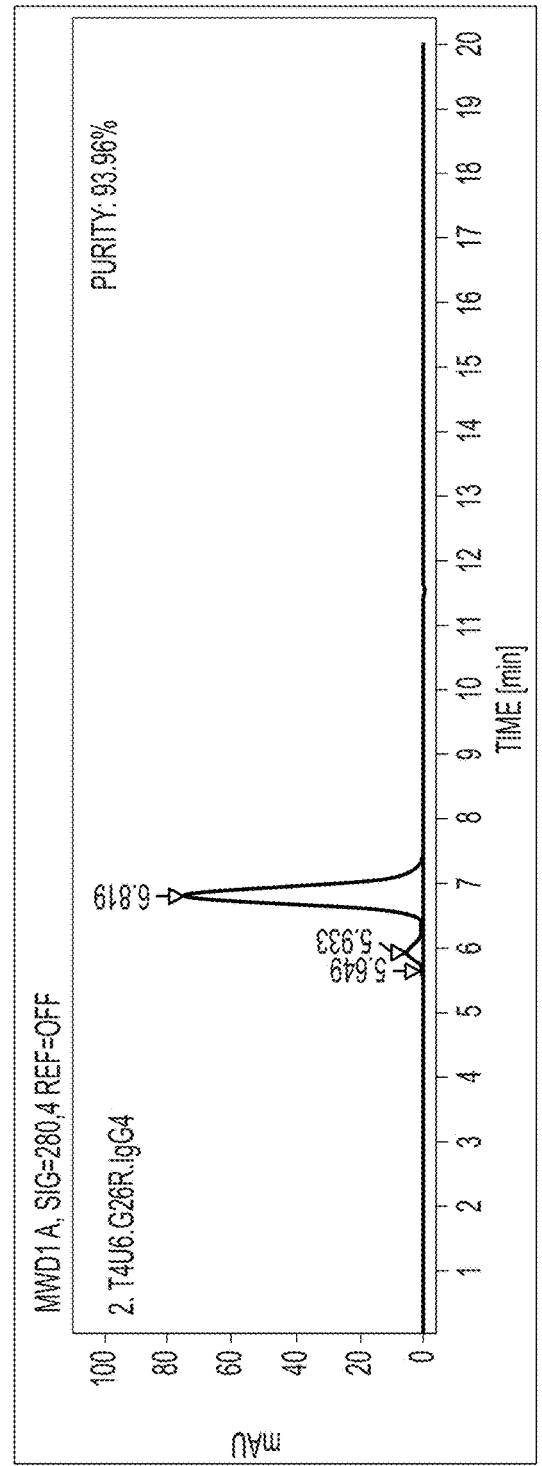
FIG. 33B

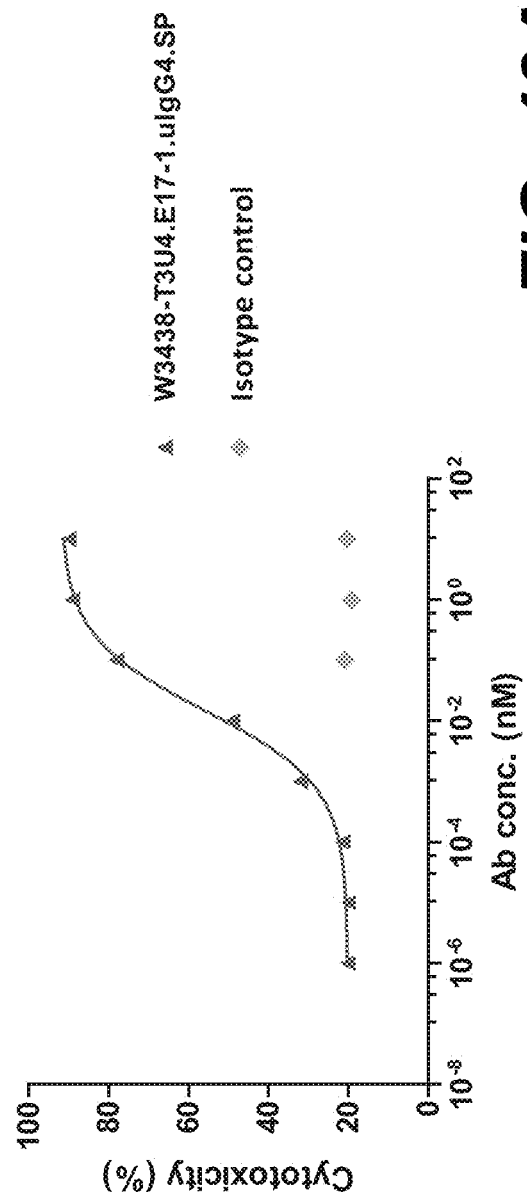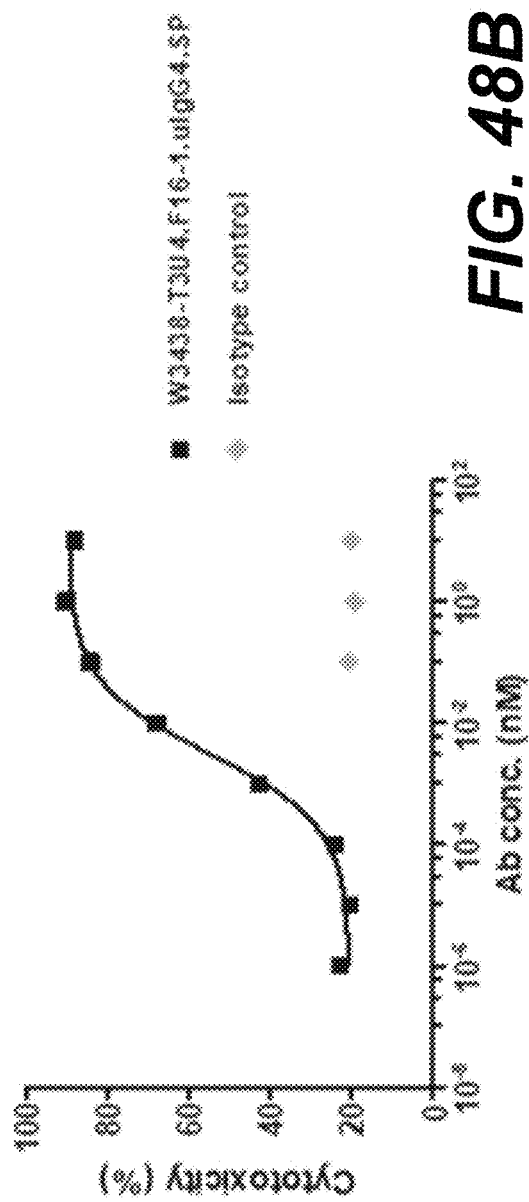

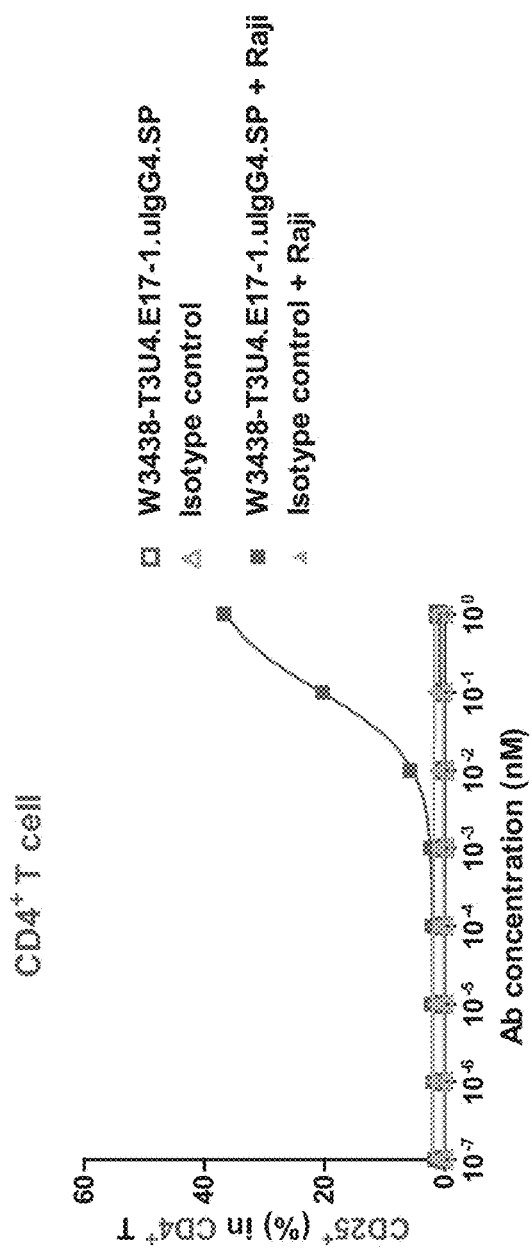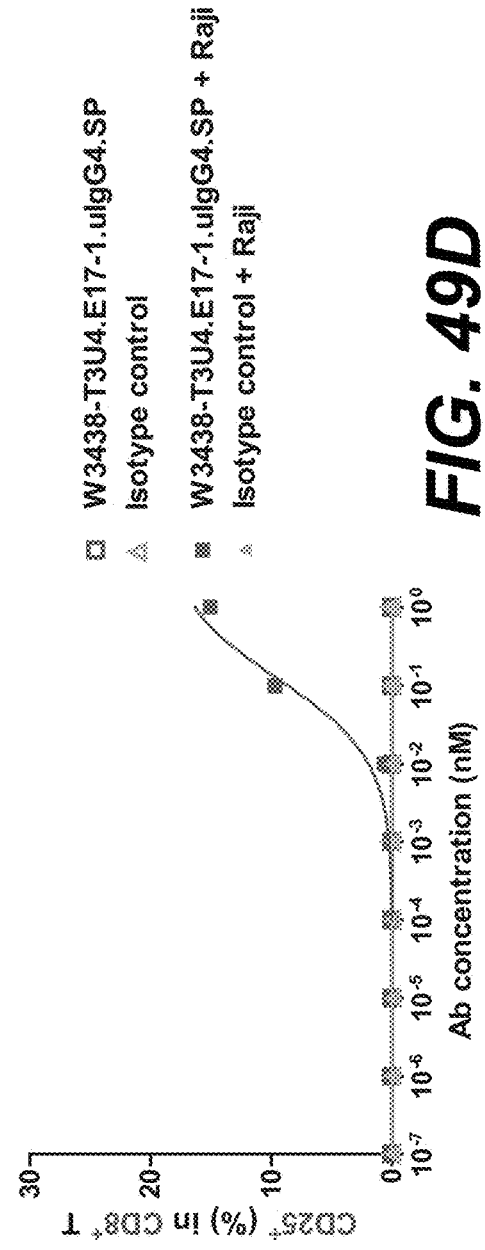

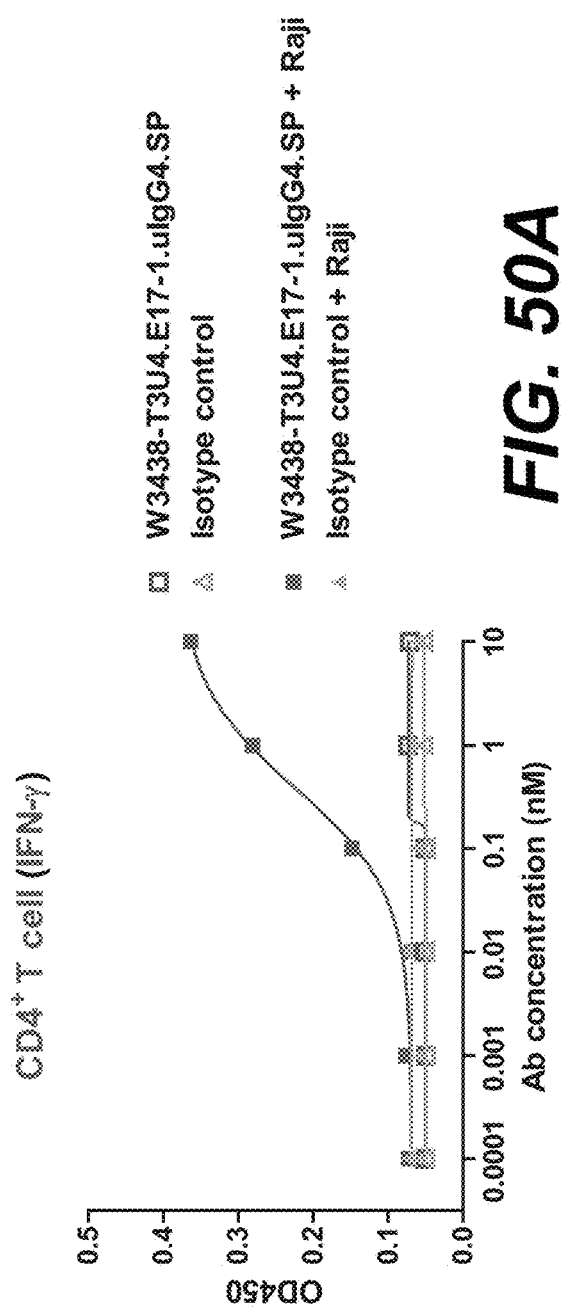
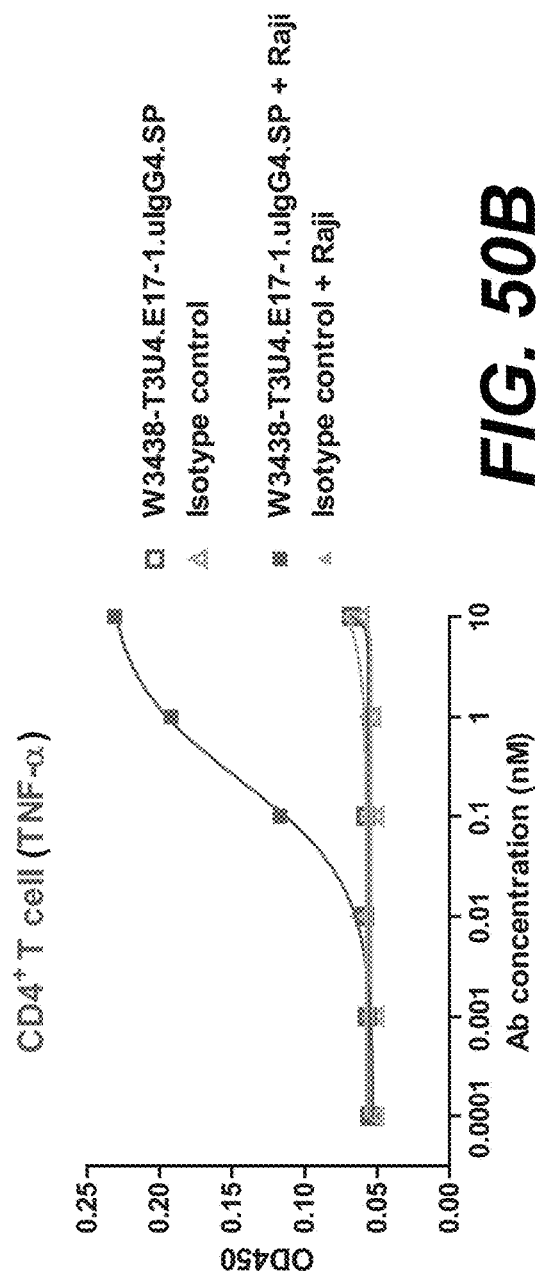
FIG. 50A
FIG. 50B

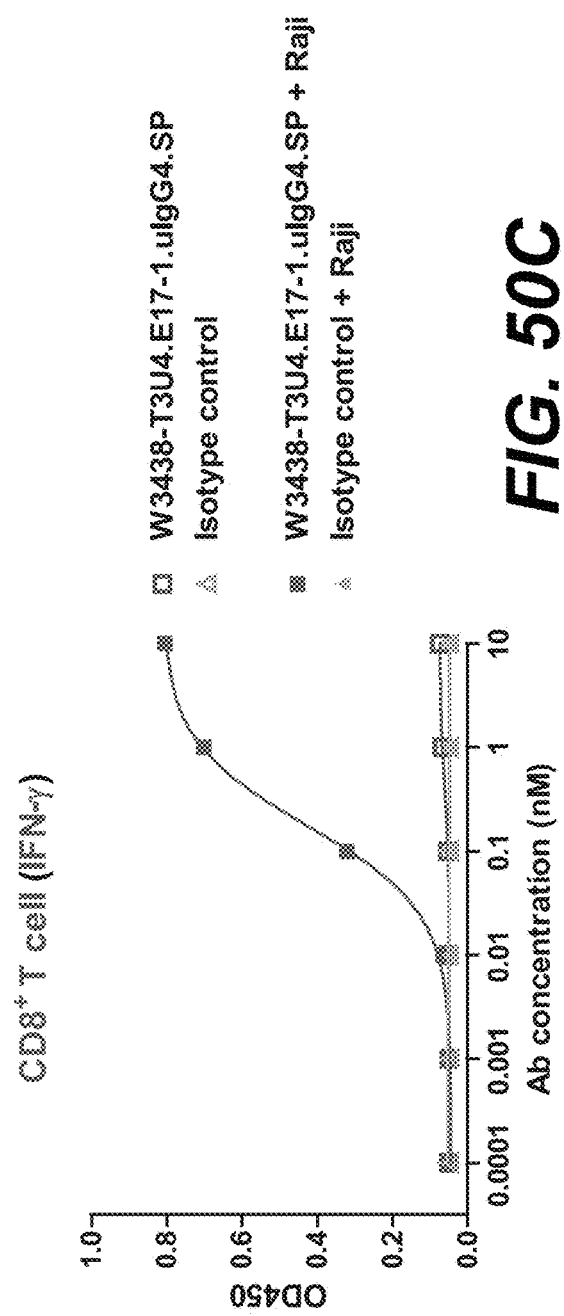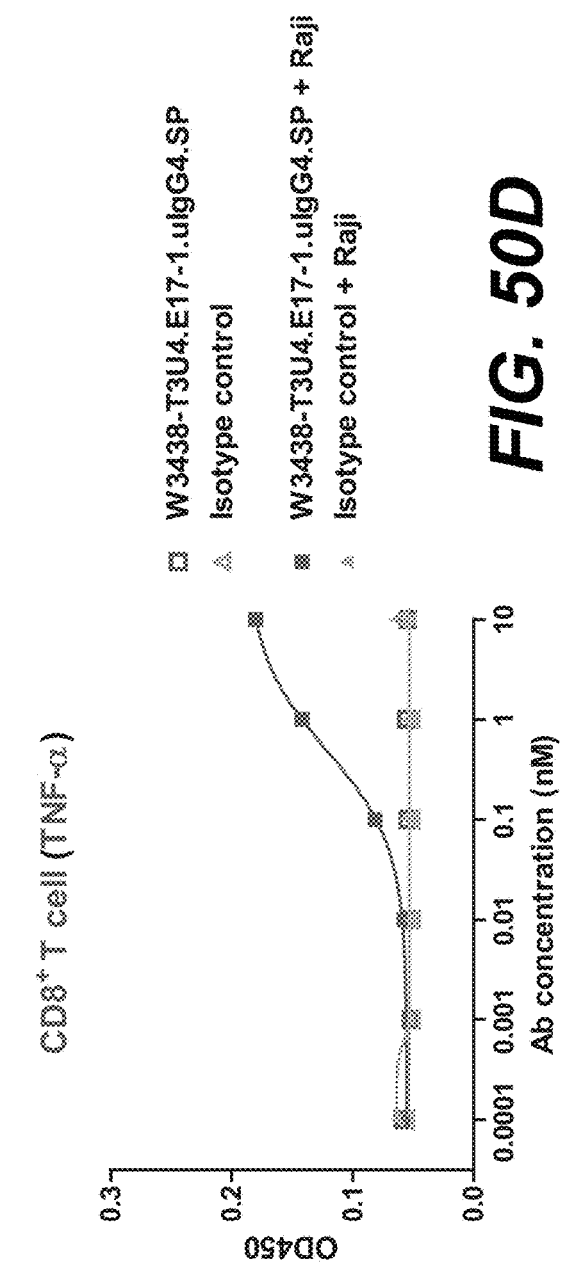

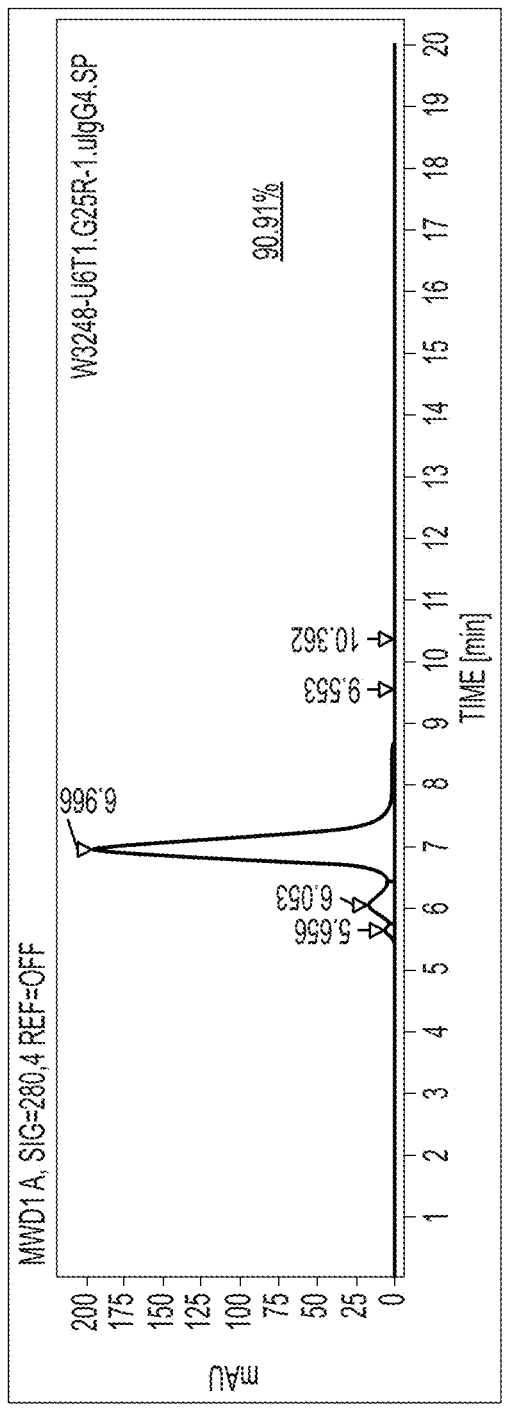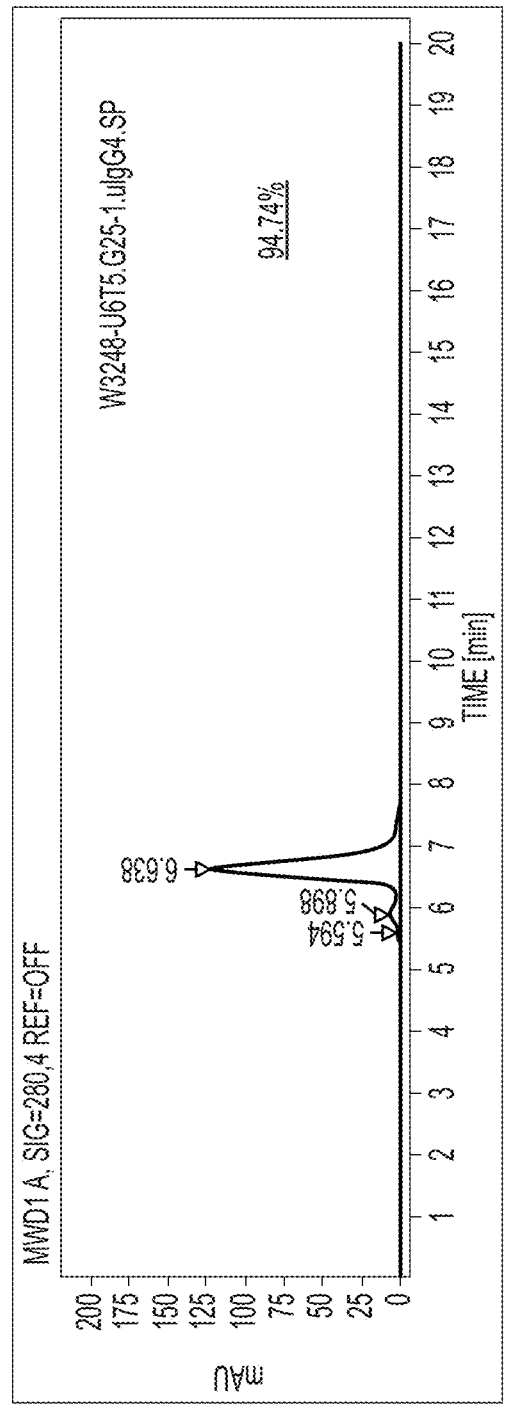
FIG. 56B

| Antibody | Isotype | Tm1 (°C) | Tm2 (°C) |
|---|---|---|---|
| W3248-U6T1.G25R-1.uIgG4.SP | hIgG4, kappa | 60.8 | 73.9 |
| W3248-U6T5.G25-1.uIgG4.SP | hIgG4, kappa | 63.4 | — |
| W324-BMK1.uIgG1.KDL | hIgG1, kappa | 57.4 | 79.6 |

*FIG. 57*

| Antibody | EC50 (nM) | MFI |
|---|---|---|
| W3248-U6T5.G25-1.uIgG4.SP | 1.176 | 32427 |
| W3248-U6T1.G25R-1.uIgG4.SP | 0.948 | 37076 |
| WBP324-BMK1.IgG1.KDL | 0.9131 | 32468 |
| W324-BMK2.uIgG4 | 2.943 | 31973 |
| W324-BMK3.uIgG4 | 0.3317 | 27715 |
| WBP305-BMK1.IgG4 | 0.3528 | 28771 |

| Antibody | EC50 (nM) | Top(MFI) |
|---|---|---|
| W3248-U6T5.G25-1.uIgG4.SP | 5.131 | 68107 |
| W3248-U6T1.G25R-1.uIgG4.SP | 4.709 | 66813 |
| WBP3055_1.153.7.hAb | 3.482 | 56664 |
| WBP324-BMK1.IgG1.KDL | 4.661 | 78382 |
| WBP305-BMK1.IgG4 | 1.435 | 69649 |

| Antibody | EC50 (nM) | Top(MFI) |
|---|---|---|
| W3248-U6T5.G25-1.uIgG4.SP | 1.45 | 11156 |
| W3248-U6T1.G25R-1.uIgG4.SP | 5.872 | 6653 |
| W3162_1.154.8-z35-IgG1K | 0.6994 | 10757 |
| WBP324-BMK1.IgG1.KDL | 2.98 | 6951 |
| WBP316-BMK1.IgG4 | 0.6737 | 8052 |

| ANALYTE | LIGAND | ka (1/Ms) | kd (1/s) | KD (M) |
|---|---|---|---|---|
| CTLA4 | W3248-U6T5.G25-1.uIgG4.SP | 8.08E+05 | 2.88E-05 | 3.56E-11 |
| | W3248-U6T1.G25R-1.uIgG4.SP | 1.83E+05 | 6.54E-05 | 3.57E-10 |
| | WBP316-BMK1.uIgG4.SPK | 3.83E+05 | 4.97E-05 | 1.30E-10 |
| PD-1 | W3248-U6T1.G25R-1.uIgG4.SP | 5.42E+05 | 6.75E-04 | 1.24E-09 |
| | W3248-U6T5.G25-1.uIgG4.SP | 6.42E+05 | 8.44E-04 | 1.32E-09 |
| | PARENTAL Ab | 3.27E+05 | 6.14E-04 | 1.88E-09 |

*FIG. 62*

| Antibody | IC$_{50}$ (nM) | Inhibition% |
|---|---|---|
| W3248-U6T5.G25-1.uIgG4.SP | 1.917 | 94.4 |
| W3248-U6T1.G25R-1.uIgG4.SP | 1.670 | 98.6 |
| WBP3055_1.153.7.hAb | 0.888 | 98.6 |
| WBP324-BMK1.IgG1.KDL | 0.8308 | 99.4 |
| WBP305-BMK1.IgG4 | 0.4536 | 99.1 |

| Antibody | IC$_{50}$ (nM) | Inhibition % |
|---|---|---|
| W3248-U6T5.G25-1.uIgG4.SP | 0.7581 | 35.9 |
| W3248-U6T1.G25R-1.uIgG4.SP | 4.300 | 24.4 |
| W3162_1.154.8-z35-IgG1K | 0.5935 | 32.9 |
| WBP324-BMK1.IgG1.KDL | 2.267 | 25.3 |
| WBP316-BMK1.IgG4 | 2.862 | 23.4 |

| Antibody | EC₅₀ (nM) | Top(OD450) |
|---|---|---|
| W3248-U6T5.G25-1.uIgG4.SP | 0.0710 | 2.178 |
| W3248-U6T1.G25R-1.uIgG4.SP | 0.1072 | 2.016 |
| WBP324-BMK1.IgG1.KDL | 0.0599 | 2.145 |

BISPECIFIC POLYPEPTIDE COMPLEXES

CROSS-REFERENCE

This application is a national stage entry under 35 U.S.C. § 371 of International Application No. PCT/CN2018/106766, filed Sep. 20, 2018, which claims priority to International Patent Application No. PCT/CN2017/103030, filed Sep. 22, 2017, the entire contents of which are incorporated herein by reference.

FIELD OF THE INVENTION

The present disclosure generally relates to soluble polypeptide complexes comprising antibody variable regions fused to the TCR constant regions, and bispecific polypeptide complexes comprising the same.

BACKGROUND

Bispecific antibodies are growing to be the new category of therapeutic antibodies. They can bind two different targets or two different epitopes on a target, creating additive or synergistic effect superior to the effect of individual antibodies. A lot of antibody engineering efforts have been put into designing new bispecific formats, such as DVD-Ig, CrossMab, BiTE etc. (Spiess et al., *Molecular Immunology*, 67(2), pp. 95-106 (2015)). However, these formats may potentially have various limitations in stability, solubility, short half-life, and immunogenicity.

Among these bispecific antibody formats, an IgG-like bispecific antibody is a common format: one arm binding to target A and another arm binding to target B. Structurally it is made from half of antibody A and half of antibody B, with the similar size and shape as natural IgG. In order to facilitate downstream development, it is desired that such bispecific molecules can be easily produced like a normal IgG from a single host cell with high expression level and correctly assembled form. Unfortunately, the pairing of cognate light-heavy chains as well as the assembly of two different half antibodies cannot be automatically controlled. All kinds of mispairings in a random manner could result in significant product heterogeneity.

By introducing mutations in the Fc region, such as "knobs-into-holes" (Ridgway et al., *Protein Engineering*, 9(7), pp. 617-21(1996); Merchant et al., *Nature Biotechnology*, 16(7), pp. 677-681(1998)), electrostatics (Gunasekaran et al., *Journal of Biological Chemistry*, 285(25), pp. 19637-19646 (2010)) or negative state designs (Kreudenstein et al., *mAbs*, 5(5), pp. 646-654 (2013); Leaver-Fay et al., *Structure*, 24(4), pp. 641-651 (2016)), the preferred heterodimeric assembly of two different heavy chains has been accomplished. However, the selective pairing of light-heavy chains of each individual antibody remains challenging. The interface between light-heavy chains includes the variable domain (VH-VL) and the constant domain (CH1-CL). Several strategies have been applied into designing orthogonal interfaces to facilitate cognate pairing. Roche swapped the domains of CH1 and CL and created the CrossMab platform (Schaefer et al., *Proceedings of the National Academy of Sciences of the United States of America*, 108(27), pp. 11187-11192 (2011)), MedImmune introduced alternatively disulphide bond (Mazor et al., *mAbs*, 7(2), pp. 377-389 (2015)), Amgen made further electrostatics in the CH1-CL region (Liu et al., *Journal of Biological Chemistry*, 290(12), pp. 7535-7562 (2015)), and Lilly (Lewis et al., *Nature Biotechnology*, 32(2), pp. 191-198 (2014)) and Genentech (Dillon et al., *mAbs*, 9(2), pp. 213-230 (2017)) introduced mutations in both variable and constant domains.

Therefore, there is great need to design bispecific molecules with desirable expression level and affinity to antigens.

BRIEF SUMMARY OF THE INVENTION

In one aspect, the present disclosure provides a polypeptide complex comprising a first polypeptide comprising, from N-terminus to C-terminus, a first heavy chain variable domain (VH) of a first antibody operably linked to a first T cell receptor (TCR) constant region (C1), and a second polypeptide comprising, from N-terminus to C-terminus, a first light chain variable domain (VL) of the first antibody operably linked to a second TCR constant region (C2), wherein C1 and C2 are capable of forming a dimer comprising at least one non-native interchain bond between C1 and C2, and the non-native interchain bond is capable of stabilizing the dimer, and the first antibody has a first antigenic specificity.

In one aspect, the present disclosure provides a bispecific polypeptide complex, comprising a first antigen-binding moiety associated with a second antigen-binding moiety, wherein the first antigen-binding moiety comprising a first polypeptide comprising, from N-terminal to C-terminal, a first heavy chain variable domain (VH) of a first antibody operably linked to a first T cell receptor (TCR) constant region (C1), and a second polypeptide comprising, from N-terminal to C-terminal, a first light chain variable domain (VL) of the first antibody operably linked to a second TCR constant region (C2), wherein C1 and C2 are capable of forming a dimer comprising at least one non-native interchain bond between a first mutated residue comprised in C1 and a second mutated residue comprised in C2, and the non-native interchain bond is capable of stabilizing the dimer, and the first antibody has a first antigenic specificity, a second antigen-binding moiety has a second antigenic specificity which is different from the first antigenic specificity, and the first antigen-binding moiety and the second antigen-binding moiety are less prone to mispair than otherwise would have been if both the first and the second antigen-binding moieties are counterparts of natural Fab.

In one aspect, the present disclosure provides herein a bispecific polypeptide complex, comprising a first antigen binding moiety comprising the polypeptide complex provided herein having a first antigenic specificity, associated with a second antigen binding moiety having a second antigenic specificity which is different from the first antigenic specificity, and the first antigen-binding moiety and the second antigen-binding moiety are less prone to mispair than otherwise would have been if both the first and the second antigen-binding moieties are counterparts of natural Fab.

In one aspect, the present disclosure provides a bispecific fragment of the bispecific polypeptide complex provided herein.

In one aspect, the present disclosure provides herein a conjugate comprising the polypeptide complex provided herein, or the bispecific polypeptide complex provided herein conjugated to a moiety.

In one aspect, the present disclosure provides herein an isolated polynucleotide encoding the polypeptide complex provided herein, or the bispecific polypeptide complex provided herein.

In one aspect, the present disclosure provides herein an isolated vector comprising the polynucleotide provided herein.

In one aspect, the present disclosure provides herein a host cell comprising the isolated polynucleotide provided herein or the isolated vector provided herein.

In one aspect, the present disclosure provides herein a method of expressing the polypeptide complex provided herein, or the bispecific polypeptide complex provided herein, comprising culturing the host cell provided herein under the condition at which the polypeptide complex, or the bispecific polypeptide complex is expressed.

In one aspect, the present disclosure provides herein a method of producing the polypeptide complex provided herein, comprising a) introducing to a host cell a first polynucleotide encoding a first polypeptide comprising, from N-terminal to C-terminal, a first heavy chain variable domain (VH) of a first antibody operably linked to a first TCR constant domain (C1), and a second polynucleotide encoding a second polypeptide comprising, from N-terminal to C-terminal, a first light chain variable domain (VL) of the first antibody operably linked to a second TCR constant domain (C2), wherein C1 and C2 are capable of forming a dimer comprising at least one non-native interchain bond between a first mutated residue comprised in C1 and a second mutated residue comprised in C2, and the non-native interchain bond is capable of stabilizing the dimer of C1 and C2, and the first antibody has a first antigenic specificity; b) allowing the host cell to express the polypeptide complex.

In one aspect, the present disclosure provides herein a method of producing the bispecific polypeptide complex provided herein, comprising a) introducing to a host cell a first polynucleotide encoding a first polypeptide comprising, from N-terminal to C-terminal, a first heavy chain variable domain (VH) of a first antibody operably linked to a first TCR constant region (C1), a second polynucleotide encoding a second polypeptide comprising, from N-terminal to C-terminal, a first light chain variable domain (VL) of the first antibody operably linked to a second TCR constant region (C2), a third polynucleotide encoding a third polypeptide comprising VH of a second antibody, and a fourth polynucleotide encoding a fourth polypeptide comprising VL of the second antibody, wherein C1 and C2 are capable of forming a dimer comprising at least one non-native interchain bond between C2, and the non-native interchain bond is capable of stabilizing the dimer, and the first antibody has a first antigenic specificity and the second antibody has a second antigenic specificity; b) allowing the host cell to express the bispecific polypeptide complex.

In certain embodiments, the method of producing the bispecific polypeptide complex provided herein further comprising isolating the polypeptide complex.

In one aspect, the present disclosure provides a composition comprising the polypeptide complex provided herein, or the bispecific polypeptide complex provided herein.

In one aspect, the present disclosure provides herein a pharmaceutical composition comprising the polypeptide complex provided herein, or the bispecific polypeptide complex provided herein and a pharmaceutically acceptable carrier.

In one aspect, the present disclosure provides herein a method of treating a condition in a subject in need thereof, comprising administering to the subject a therapeutically effective amount of the polypeptide complex provided herein, or the bispecific polypeptide complex provided herein. In certain embodiments, the condition can be alleviated, eliminated, treated, or prevented when the first antigen and the second antigen are both modulated.

In certain embodiments, the non-native interchain bond is formed between a first mutated residue comprised in C1 and a second mutated residue comprised in C2. In certain embodiments, at least one of the first and the second mutated residues is a cysteine residue.

In certain embodiments, the non-native interchain bond is a disulphide bond.

In certain embodiments, the first mutated residue is comprised within a contact interface of C1, and/or the second mutated residue is comprised within a contact interface of C2.

In certain embodiments, at least one native cysteine residue is absent or present in C1 and/or C2. In certain embodiments, the native cysteine residue at position C74 of engineered CBeta is absent or present. In certain embodiments, the native C74 is absent in CBeta.

In certain embodiments, at least one native N-glycosylation site is absent or present in C1 and/or C2. In certain embodiments, the native N-glycosylation sites are absent in C1 and/or C2.

In certain embodiments, the dimer comprises 1, 2, 3, 4, 5, 6, 7, 8, 9, 10, 11, 12, 13, 14, 15 or more non-native interchain bonds. In certain embodiments, at least one of the non-native interchain bonds is disulphide bond. In certain embodiments, the dimer comprises 1, 2, 3, 4, 5, 6, 7, 8, 9, 10, 11, 12, 13, 14, 15 or more disulphide bonds.

In certain embodiments, a) C1 comprises an engineered CBeta, and C2 comprises an engineered CAlpha; b) C1 comprises an engineered CAlpha, and C2 comprises an engineered CBeta; c) C1 comprises an engineered CBeta, and C2 comprises an engineered CPre-Alpha; d) C1 comprises an engineered CPre-Alpha, and C2 comprises an engineered CBeta; e) C1 comprises an engineered CGamma, and C2 comprises an engineered CDelta; or f) C1 comprises an engineered CDelta, and C2 comprises an engineered CGamma.

In certain embodiments, the first VH is operably linked to C1 at a first conjunction domain, and the first VL is operably linked to C2 at a second conjunction domain. In certain embodiments, the first VH associates to C1 at a first conjunction domain via a connector, the first VL associates to C2 at a second conjunction domain via a connector.

In certain embodiments, the first and/or the second conjunction domain comprises a proper length (e.g., 0, 1, 2, 3, 4, 5, 6, 7, 8, 9, or 10 amino acid residues) of the C terminal fragment of antibody V/C conjunction, and a proper length (e.g., 0, 1, 2, 3, 4, 5, 6, 7, 8, 9, or 10 amino acid residues) of the N terminal fragment of TCR V/C conjunction.

In certain embodiments, the engineered CBeta comprises a mutated cysteine residue within a contact interface selected from the group consisting of amino acid residues 9-35, 52-66, 71-86, and 122-127; and/or the engineered CAlpha comprises a mutated cysteine residue within a contact interface selected from a group consisting of amino acid residues 6-29, 37-67, and 86-95.

In certain embodiments, the engineered CBeta comprises a mutated cysteine residue that substitutes for an amino acid residue at a position selected from: S56C, S16C, F13C, V12C, E14C, L62C, D58C, S76C, and R78C, and/or the engineered CAlpha comprises a mutated cysteine residue that substitutes for an amino acid residue at a position selected from: T49C, Y11C, L13C, S16C, V23C, Y44C, T46C, L51C, and S62C.

In certain embodiments, the engineered CBeta and the engineered CAlpha comprise a pair of mutated cysteine residues that substitute for a pair of amino acid residues selected from the group consisting of: S16C in CBeta and Y11C in CAlpha, F13C in CBeta and L13C in CAlpha, S16C in CBeta and L13C in CAlpha, V12C in CBeta and S16C in CAlpha, E14C in CBeta and S16C in CAlpha, F13C in CBeta and V23C in CAlpha, L62C in CBeta and Y44C in CAlpha, D58C in CBeta and T46C in CAlpha, S76C in CBeta and T46C in CAlpha, S56C in CBeta and T49C in CAlpha, S56C in CBeta and L51C in CAlpha, S56C in CBeta and S62C in CAlpha, and R78C in CBeta and S62C in CAlpha, and wherein the pair of cysteine residues are capable of forming a non-native interchain disulphide bond.

In certain embodiments, at least one native glycosylation site is absent or present in the engineered CBeta and/or in the engineered CAlpha.

In certain embodiments, the native glycosylation site in the engineered CBeta is N69, and/or the native glycosylation site(s) in the engineered CAlpha is/are selected from N34, N68, N79, and any combination thereof.

In certain embodiments, the engineered CBeta lacks or retains a FG loop encompassing amino acid residues 101-117 of the native CBeta and/or a DE loop encompassing amino acid residues 66-71 of the native CBeta.

In certain embodiments, the engineered CAlpha comprises any one of SEQ ID NOs: 43-48, and/or the engineered CBeta comprises any one of SEQ ID NOs: 33-41 and 306.

In certain embodiments, C1 comprises the engineered CBeta, and C2 comprises the engineered CAlpha; and wherein the first conjunction domain comprises or is SEQ ID NO: 49 or 50, and/or the second conjunction domain comprises or is SEQ ID NO: 51 or 52.

In certain embodiments, the C1 comprises the engineered CAlpha, and the C2 comprises the engineered CBeta; and wherein the first conjunction domain comprises or is SEQ ID NO: 129 or 130, and/or the second conjunction domain comprises or is SEQ ID NO: 49 or 50.

In certain embodiments, the engineered CBeta comprises a mutated cysteine residue within a contact interface selected from the group consisting of: amino acid residues 9-35, 52-66, 71-86 and 122-127; and/or the engineered CPre-Alpha comprises a mutated cysteine residue within a contact interface selected from a group consisting of: amino acid residues 7-19, 26-34, 56-75 and 103-106.

In certain embodiments, the engineered CBeta comprises a mutated cysteine residue that substitutes for an amino acid residue at a position selected from: S16C, A18C, E19C, F13C, A11C, S56C, and S76C, and/or the engineered CPre-Alpha comprises a mutated cysteine residue that substitutes for an amino acid residue at a position selected from S11C, A13C, I16C, S62C, T65C, and Y59C.

In certain embodiments, the engineered CBeta and the engineered CPre-Alpha comprise a pair of mutated cysteine residues that substitute for a pair of amino acid residues selected from the group consisting of: S16C in CBeta and S11C in CPre-Alpha, A18C in CBeta and S11C in CPre-Alpha, E19C in CBeta and S11C in CPre-Alpha, F13C in CBeta and A13C in CPre-Alpha, S16C in CBeta and A13C in CPre-Alpha, A11C in CBeta and I16C in CPre-Alpha, S56C in CBeta and S62C in CPre-Alpha, S56C in CBeta and T65C in CPre-Alpha, and S76C in CBeta, and Y59C in CPre-Alpha, and wherein the pair of mutated cysteine residues are capable of forming a non-native interchain disulphide bond.

In certain embodiments, at least one native glycosylation site is absent in the engineered CBeta and/or in the engineered CPre-Alpha.

In certain embodiments, the absent or present glycosylation site in the engineered CBeta is N69, and/or the absent glycosylation site in the engineered CPre-Alpha is N50.

In certain embodiments, the engineered CBeta lacks or retains a FG loop encompassing the amino acid residues 101-107 of the native CBeta and/or a DE loop at position encompassing the amino acid residues 66-71 of the native CBeta.

In certain embodiments, the engineered CPre-Alpha comprises any one of SEQ ID NOs: 82, 83, and 311-318; and/or the engineered CBeta comprises any one of SEQ ID NOs: 84, 33-41, and 319-324.

In certain embodiments, C1 comprises the engineered CBeta, and C2 comprises the engineered CPre-Alpha; and wherein the first conjunction domain comprises SEQ ID NO: 49 or 50, and/or the second conjunction domain comprises SEQ ID NO: 81 or 131.

In certain embodiments, C1 comprises the engineered CPre-Alpha, and C2 comprises the engineered CBeta; and wherein the first conjunction domain comprises SEQ ID NO: 132 or 133, and/or the second conjunction domain comprises SEQ ID NO: 49 or 50.

In certain embodiments, the engineered CDelta comprises a mutated cysteine residue within a contact interface selected from the group consisting of: amino acid residues 8-26, 43-64, and 84-88; and/or the engineered CGamma comprises a mutated cysteine residue within a contact interface selected from a group consisting of: amino acid residues 11-35 and 55-76.

In certain embodiments, the engineered CGamma comprises a mutated cysteine residue that substitutes for an amino acid residue at a position selected from: S17C, E20C, F14C, T12C, M62C, Q57C, and A19C, and/or the engineered CDelta comprises a mutated cysteine residue that substitutes for an amino acid residue at a position selected from: F12C, M14C, N16C, D46C, V50C, F87C, and E88C.

In certain embodiments, the engineered CGamma and the engineered CDelta comprise a pair of mutated cysteine residues that substitute for a pair of amino acid residues selected from the group consisting of: S17C in CGamma and F12C in CDelta, E20C in CGamma and F12C in CDelta, F14C in CGamma and M14C in CDelta, T12C in CGamma and N16C in CDelta, M62C in CGamma and D46C in CDelta, Q57C in CGamma and V50C in CDelta, A19C in CGamma and F87C in CDelta, and A19C in CGamma and E88C in CDelta, and wherein the introduced pair of cysteine residues are capable of forming an interchain disulphide bond.

In certain embodiments, at least one native glycosylation site is absent or present in the engineered CGamma and/or in the engineered CDelta.

In certain embodiments, the native glycosylation site in the engineered CGamma is N65, and/or the native glycosylation site(s) in the engineered CDelta is/are one or both of N16 and N79.

In certain embodiments, the engineered CGamma comprises SEQ ID NO: 113, 114, 333, 334, 335, 336, 337, 338, 339, or 340, and/or the engineered CDelta comprises SEQ ID NO: 115, 116, 310, 325, 326, 327, 328, 329, 330, 331, or 332.

In certain embodiments, C1 comprises the engineered CGamma, and C2 comprises the engineered CDelta; and wherein the first conjunction domain comprises SEQ ID NO: 117 or 118, and/or the second conjunction domain comprises SEQ ID NO: 119 or 120.

In certain embodiments, C1 comprises the engineered CDelta, and C2 comprises the engineered CGamma; and wherein the first conjunction domain comprises SEQ ID NO: 123 or 124, and/or the second conjunction domain comprises SEQ ID NO: 125 or 126.

In certain embodiments, the first polypeptide further comprises an antibody CH2 domain, and/or an antibody CH3 domain.

In certain embodiments, the first antigenic specificity and the second antigenic specificity are directed to two different antigens, or are directed to two different epitopes on one antigen.

In certain embodiments, the first antigen-binding moiety binds to CD3. In certain embodiments, the second antigen-binding moiety binds to CD19. In certain embodiments, the first antigen-binding moiety binds to CD19. In certain embodiments, the second antigen-binding moiety binds to CD3.

In certain embodiments, the first antigen-binding moiety binds to CTLA-4. In certain embodiments, the second antigen-binding moiety binds to PD-1. In certain embodiments, the first antigen-binding moiety binds to PD-1. In certain embodiments, the second antigen-binding moiety binds to CTLA-4.

In certain embodiments, the association is via a connecter, a disulphide bond, a hydrogen bond, electrostatic interaction, a salt bridge, or hydrophobic-hydrophilic interaction, or the combination thereof.

In certain embodiments, the second antigen-binding moiety comprises a heavy chain variable domain and a light chain variable domain of a second antibody having the second antigenic specificity.

In certain embodiments, the second antigen-binding moiety comprises a Fab.

In certain embodiments, the first antigenic specificity and the second antigenic specificity are directed to two different antigens, or are directed to two different epitopes on one antigen.

In certain embodiments, one of the first and the second antigenic specificities is directed to a T-cell specific receptor molecule and/or a natural killer cell (NK cell) specific receptor molecule, and the other is directed to a tumor associated antigen.

In certain embodiments, one of the first and the second antigenic specificities is directed to CD3, and the other is directed to a tumor associated antigen.

In certain embodiments, one of the first and the second antigenic specificities is directed to CD3, and the other is directed to CD19.

In certain embodiments, the first antigen-binding moiety further comprises a first dimerization domain, and the second antigen-binding moiety further comprises a second dimerization domain, wherein the first and the second dimerization domains are associated.

In certain embodiments, the association is via a connecter, a disulphide bond, a hydrogen bond, electrostatic interaction, a salt bridge, or hydrophobic-hydrophilic interaction, or the combination thereof.

In certain embodiments, the first and/or the second dimerization domain comprises at least a portion of an antibody hinge region, optionally derived from IgG1, IgG2 or IgG4.

In certain embodiments, the first and/or the second dimerization domain further comprises a dimerization domain. In certain embodiments, the dimerization domain comprises at least a portion of an antibody hinge region, an antibody CH2 domain, and/or an antibody CH3 domain.

In certain embodiments, the first dimerization domain is operably linked to the first TCR constant region (C1) at a third conjunction domain.

In certain embodiments, a) C1 comprises an engineered CBeta, and the third conjunction domain is comprised in SEQ ID NO: 53 or 54; b) C1 comprises an engineered CAlpha, and the third conjunction domain is comprised in SEQ ID NO: 134, 135, 140, or 141; c) C1 comprises an engineered CPre-Alpha, and the third conjunction domain is comprised in SEQ ID NO: 134, 135, 140, or 141; d) C1 comprises an engineered CGamma, and the third conjunction domain is comprised in SEQ ID NO: 121 or 122; or e) C1 comprises an engineered CDelta, and the third conjunction domain is comprised in SEQ ID NO: 127 or 128.

In certain embodiments, the second dimerization domain is operably linked to the heavy chain variable domain of the second antigen-binding moiety.

In certain embodiments, the first and the second dimerization domains are different and associate in a way that discourages homodimerization and/or favors heterodimerization.

In certain embodiments, the first and the second dimerization domains are capable of associating into heterodimers via knobs-into-holes, hydrophobic interaction, electrostatic interaction, hydrophilic interaction, or increased flexibility.

In certain embodiments, the first antigen-binding moiety comprising the first polypeptide comprising VH operably linked to a chimeric constant region, and the second polypeptide comprises VL operably linked to C2, wherein the chimeric constant region and C2 comprises a pair of sequences selected from the group consisting of: SEQ ID NOs: 177/176, 179/178, 184/183, 185/183, 180/176, 181/178, 182/178, 184/186, 185/186, 188/187, 196/187, 190/189, 192/191, 192/193, 195/194, 198/197, 200/199, 202/201, 203/201, 203/204, 205/204, 206/204, 208/207, 208/209, 211/210, 213/212, 213/215, 213/151, 214/212, 214/151, 232/231, 216/215, 218/217, 220/219, 222/221, 224/223, 226/225, 227/223, 229/228, 229/230, 236/235, and 238/237.

In certain embodiments, the first antigenicity is directed to CD3, and the first polypeptide and the second polypeptide comprise a pair of sequences selected from the group consisting of: SEQ ID NOs: 2/1, 3/4/, 5/1, 6/3, 7/3, 9/8, 10/8, 9/11, 10/11, 13/12, 15/14, 17/16, 17/18, 20/19, 21/12, 65/64, 67/66, 69/68, 70/68, 70/71, 72/71, 73/71, 75/74, 75/76, 78/77, 86/85, 90/89, 91/92/, 94/93, 96/95, 98/97, 99/95, 101/100, 101/102, 106/105, 108/107, 110/109, 112/111, 137/136, 138/136, 137/139, and 138/139.

In certain embodiments, the first antigen-binding moiety and the second antigen-binding moiety comprise a four-sequence combination selected from the group consisting of: SEQ ID NOs: 22/12/24/23, 25/12/26/23, and 25/12/27/23, wherein the first antigen-binding moiety is capable of binding to CD3, and the second antigen-binding moiety is capable of binding to CD19.

In certain embodiments, the polypeptide complex provided herein can be made into a Fab, a (Fab)$_2$, a bibody, a tribody, a triFabs, tandem linked Fabs, a Fab-Fv, tandem linked V domains, tandem linked scFvs, and among other formats.

In another aspect, the present disclosure provides a kit comprising the polypeptide complex provided herein for detection, diagnosis, prognosis, or treatment of a disease or condition.

The foregoing and other features and advantages of the invention will become more apparent from the following detailed description of several embodiments which proceeds with reference to the accompanying figures.

BRIEF DESCRIPTION OF FIGURES

FIGS. 2A-2D present superimposed poses of antibody Fv model and TCR structure providing guidance in fusing antibody Fv and TCR constant region. FIG. 2A presents an antibody Fv structure model that was built based on the sequence of an anti-CD3 antibody T3 developed in-house. FIG. 2B presents the TCR structure from PDB 4L4T. FIG. 2C presents an antibody Fv structural model superimposed on the TCR variable region in different orientations. Rough chimeric proteins were created by removing the TCR variable domain in the superimposed poses, as shown in FIG. 2D. The overlapped residues in the conjunction area helped design conjunction region. The antibody VL chain and the TCR alpha chain were colored in white. The VH and beta chains were colored in black.

FIG. 3A shows a TCR crystal structure from PDB 4L4T. FIG. 3B shows antibody Fab structural model made by the Fv domain of T3 model and the constant domain of antibody from PDB 5DK3. The obvious differences in FG and DE loops between constant domains of TCR and constant domains of antibody Fab were marked by displaying all the residues side chains.

FIG. 15A shows the antibody containing interchain disulphide bond between CAlpha and CBeta; FIG. 15B shows the antibody without interchain disulphide bond between CAlpha and CBeta; Lanes 1 and 3 are the non-reduced PAGE results of Design_2-QQQQ-IgG4 with and without introduced disulphide bond, respectively. Lanes 2 and 4 are the reduced PAGE results of Design_2-QQQQ-IgG4 with and without introduced disulphide bond, respectively.

FIG. 17A is non-reduced SDS-PAGE. FIG. 17B is reduced SDS-PAGE.

FIG. 18A shows the sequence of native TCR alpha chain and its counterpart sequence with mutated cysteine residues. TRAC_Human is a natural sequence of alpha chain constant region. 4L4T_Alpha_Crystal is the sequence of a crystal structure (PDB code 4L4T) with S55C mutations that can form inter-chain disulphide bond. The gray region is the constant region used as backbone of chimeric protein in this invention.

FIG. 18B shows the sequence of native TCR beta chain and its counterpart sequence with mutated cysteine residues. TRBC1_Human and TRBC2_Human are natural sequences of beta constant region.

FIG. 18C shows the sequences of native TCR pre-alpha chain. PTCRA_Human is a natural sequence of pre-alpha chain constant region (pre-alpha chain only has no variable region). 30F6_PreAlpha_Crystal is the sequence of a crystal structure (PDB code 3OF6). The gray region is the constant region used above to define the numbering.

FIG. 18D shows the sequences of native TCR delta chain. TRA@_Human is the natural sequences of delta constant region. 4LFH_Delta_Crystal is the constant region of a delta chain sequence of a crystal structure (PDB code 4LFH). The gray region is the constant region used above to define the numbering.

FIG. 18E shows the sequences of native TCR gamma chain. TRGC1_Human and TRGC2_Human are natural sequences of gamma constant region. 4LFH_Gamma_Crystal is the constant region of a gamma chain sequence of a crystal structure (PDB code 4LFH). The gray region is the constant region used above to define the numbering.

FIGS. 19A-19E show the sequences and numbering of the TCR constant regions. FIG. 19A shows the sequences and numbering of the TCR Alpha constant region. FIG. 19B shows the sequences and numbering of the TCR Beta constant region. FIG. 19C shows the sequences and numbering of the TCR Pre-Alpha constant region. FIG. 19D shows the sequences and numbering of the TCR Delta constant region. FIG. 19E shows the sequences and numbering of the TCR Gamma constant region.

FIGS. 20A-20D show the sequences and numbering of the IgG1 and IgG4 knobs-into-holes. FIG. 20A shows the sequences and numbering of the IgG1 "knob" mutations. FIG. 20B shows the sequences and numbering of the IgG4 "knob" mutations. FIG. 20C shows the sequences and numbering of the IgG1 "hole" mutations. FIG. 20D shows the sequences and numbering of the IgG4 "hole" mutations.

FIG. 22 shows schematic description of four symmetric WuXiBody formats G19, G19R, G25 and G25R. For formats G19 and G25, two TCR-containing chimeric Fab-like domains were grafted at the C-terminus and N-terminus of a normal antibody, respectively. The rectangles indicate TCR constant domains, and the ovals indicate variable and constant domains of an antibody. The difference between formats G19 and G19R or G25 and G25R is the switched position of normal Fab and chimeric Fab. These formats can accommodate different variable regions from different antibody pairs and usually have a molecular weight around 240-250 kD.

FIGS. 23A-23B show SDS-PAGE (FIG. 23A) and SEC-HPLC (FIG. 23B) characterizations of two purified bispecific antibodies in G19 format. The lane numbers in SDS-PAGE are consistent with the label numbers in the SEC-HPLC figure. Lanes 1 and 2 are the T1U6 and U6T1 antibody pair, respectively. In T1U6, T1 (anti-CTLA-4) was on the N-terminus of the format, whereas in U6T1 U6 (anti-PD-1) was on the N-terminus of the format. Both bispecific molecules were purified by protein A chromatography, and purities around 90% was achieved.

FIGS. 33A-33B show SDS-PAGE (FIG. 33A) and SEC-HPLC (FIG. 33B) characterizations of the Protein A-purified bispecific antibodies in G27 and G26R formats. Lanes 1-2 are the T4U6 antibody pair in G27 and G26R formats, respectively. Only the one in G26R format achieved 90% purity after purification. The lane numbers in SDS-PAGE are consistent with the label numbers in SEC-HPLC figures.

Figure 34A:
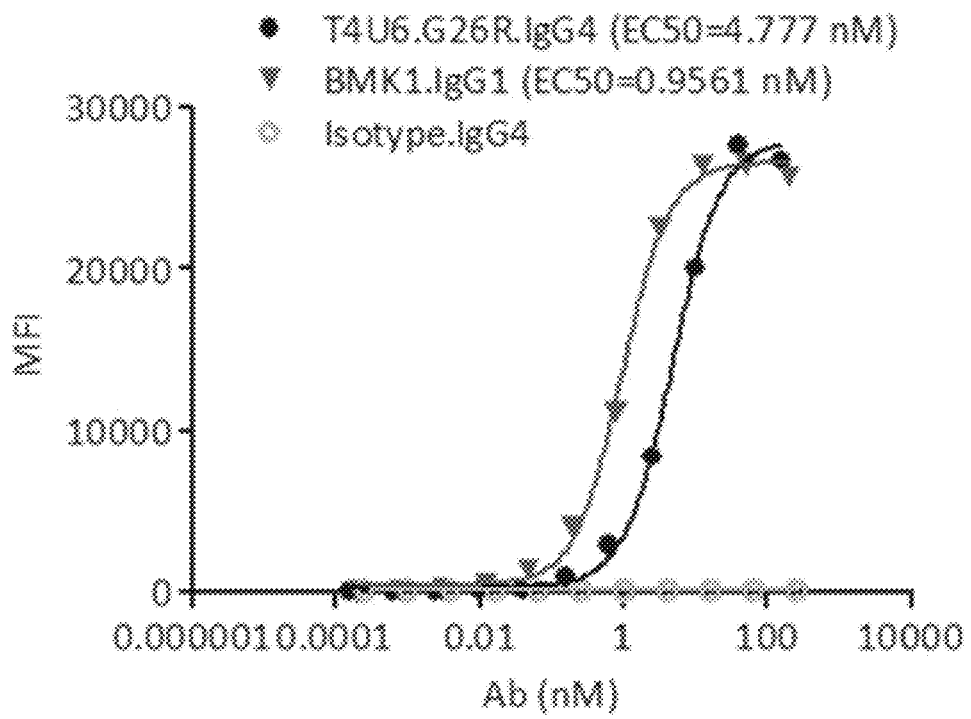
Figure 34B:
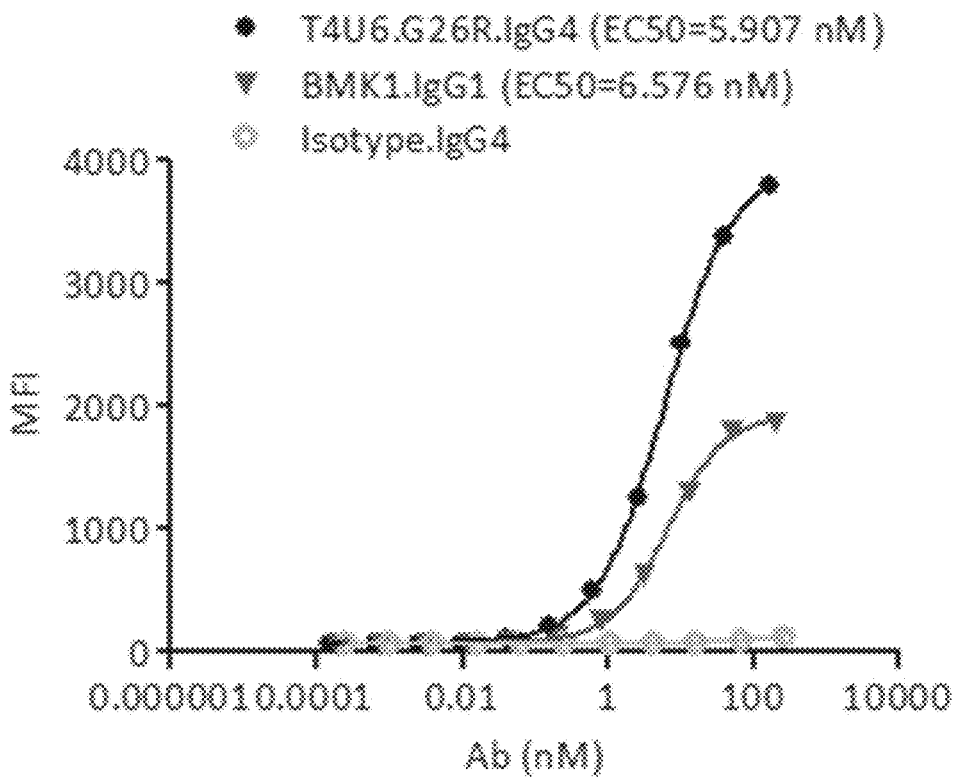

FIGS. 34A-34B show dose-dependent FACS bindings of purified bispecific T4U6 antibody pair in G26R format to human PD-1 (FIG. 34A) and CTLA-4 (FIG. 34B) engineered cells. A benchmark bispecific anti-CTAL-4×PD-1 antibody (BMK1.IgG1) was used as a control, and an IgG4 antibody was used as the negative control.

Figure 35A:
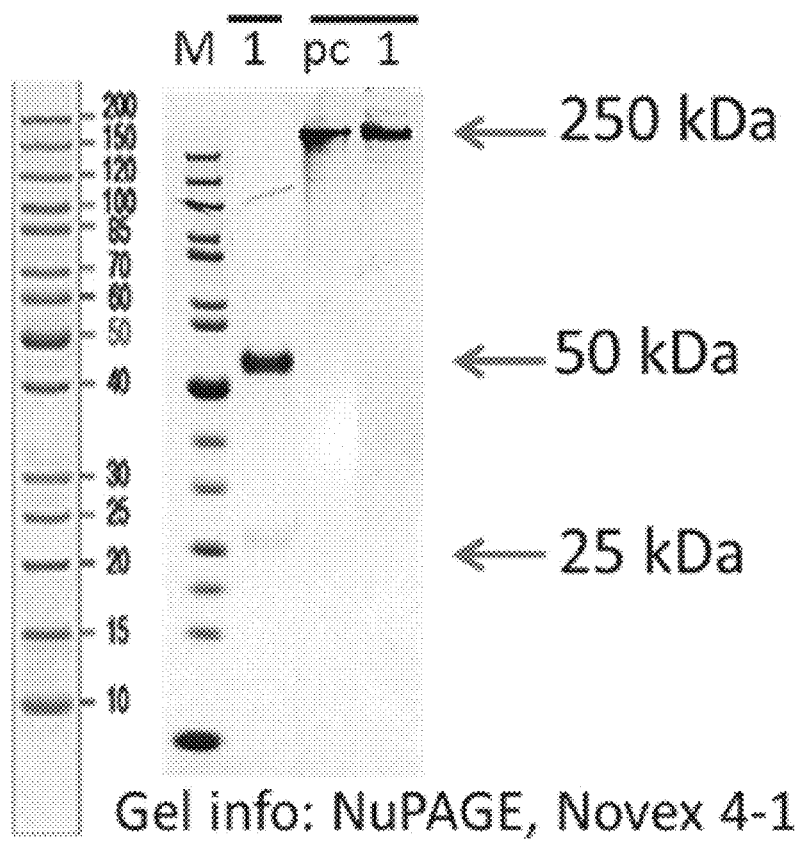
Figure 35B:
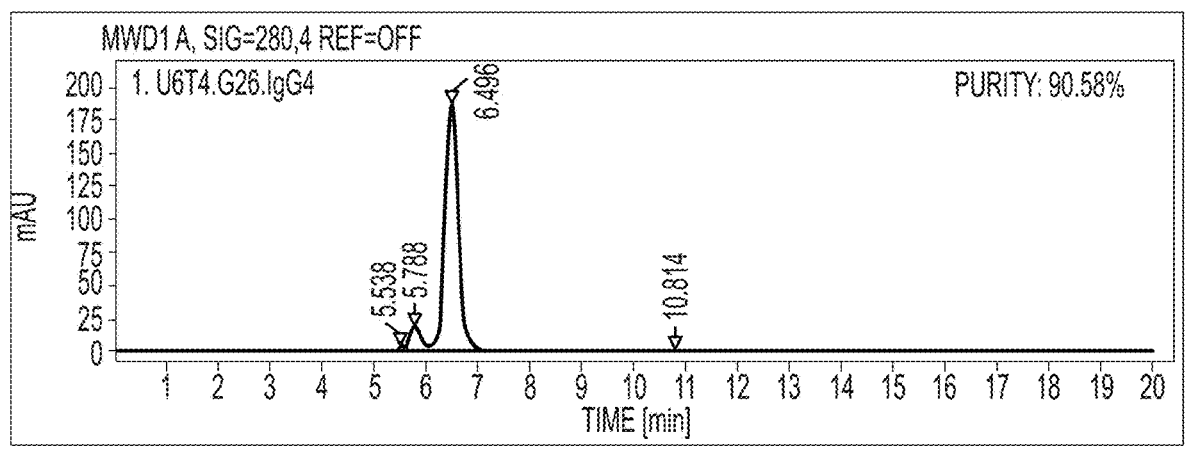
Figure 36A:
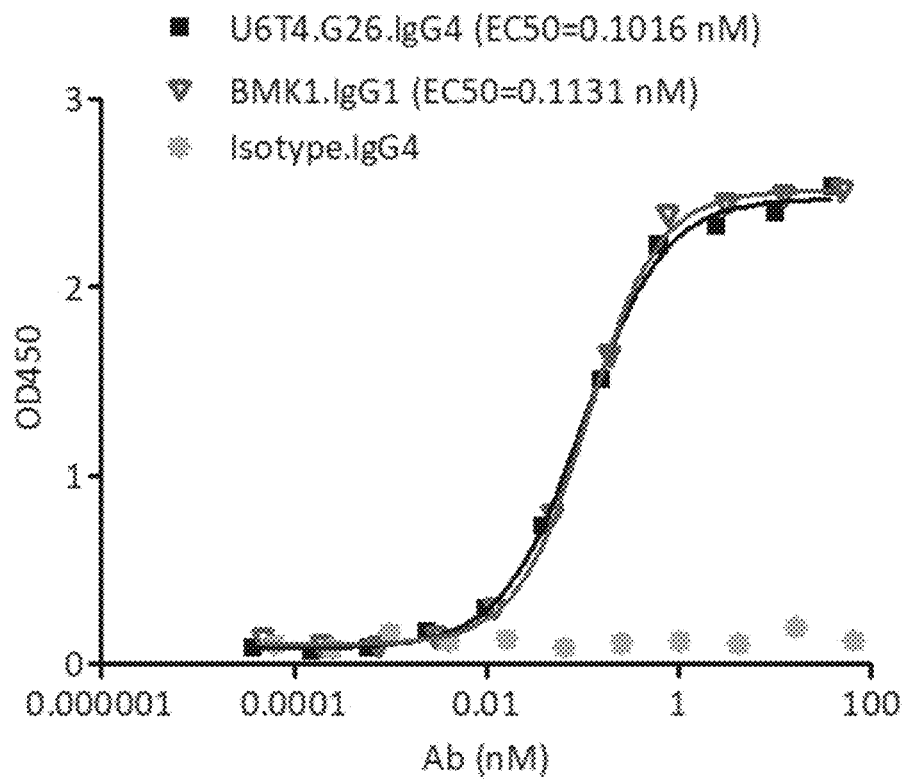
Figure 36B:
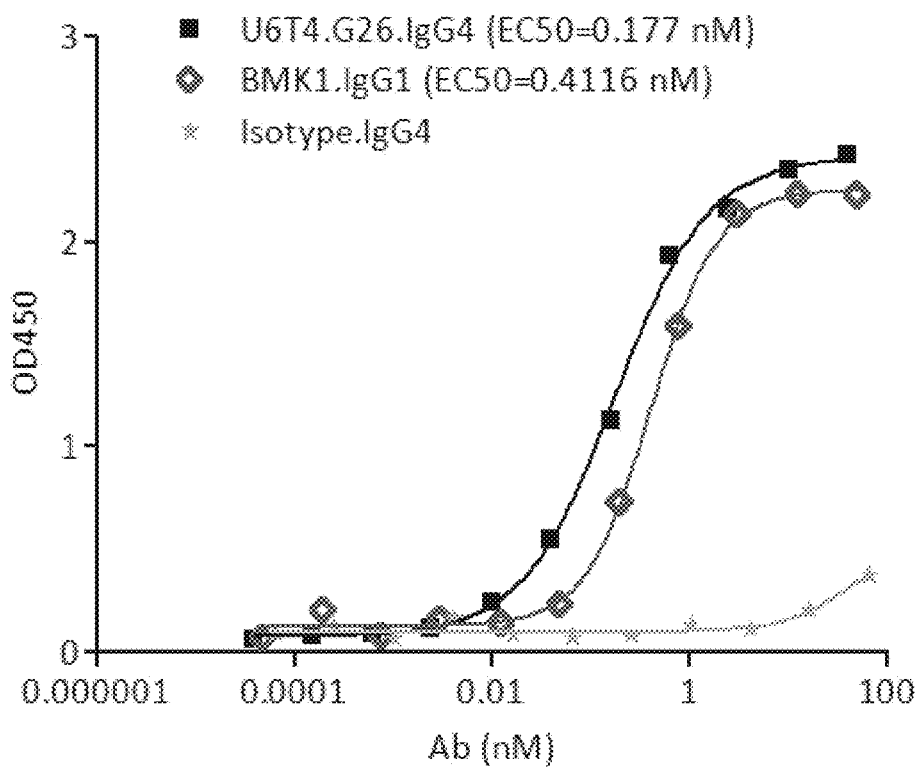
Figure 36C:
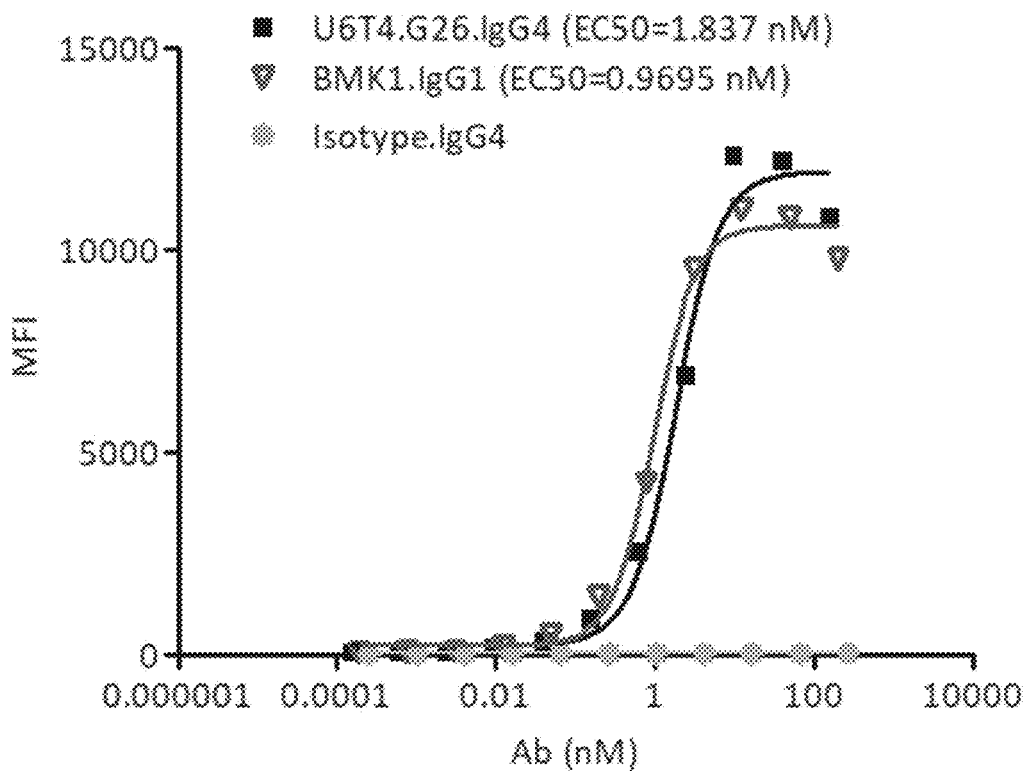
Figure 36D:
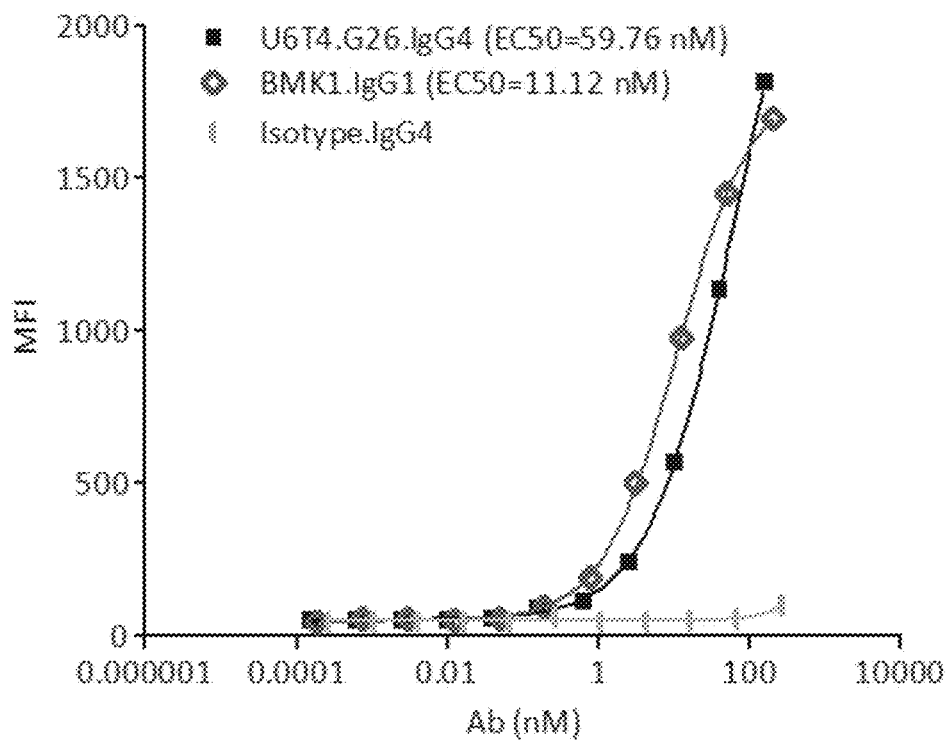

FIGS. 35A-35B show SDS-PAGE (FIG. 35A) and SEC-HPLC (FIG. 35B) characterizations of the Protein A-purified bispecific U6T4 antibody pair in G26 format. It achieved 90% purity after purification.

FIGS. 36A-36D show dose-dependent ELISA bindings of purified bispecific U6T4 antibody pair in G26 format to human PD-1 (FIG. 36A) and CTLA-4 (FIG. 36B) engineered cells, as well as dose-dependent FACS bindings of purified bispecific U6T4 antibody pair in G26 format to human PD-1 (FIG. 36C) and CTLA-4 (FIG. 36D) engineered cells. A benchmark bispecific anti-CTAL-4×PD-1 antibody (BMK1.IgG1) was used as a control, and an irrelevant IgG4 antibody was used as the negative control.

Figure 37:
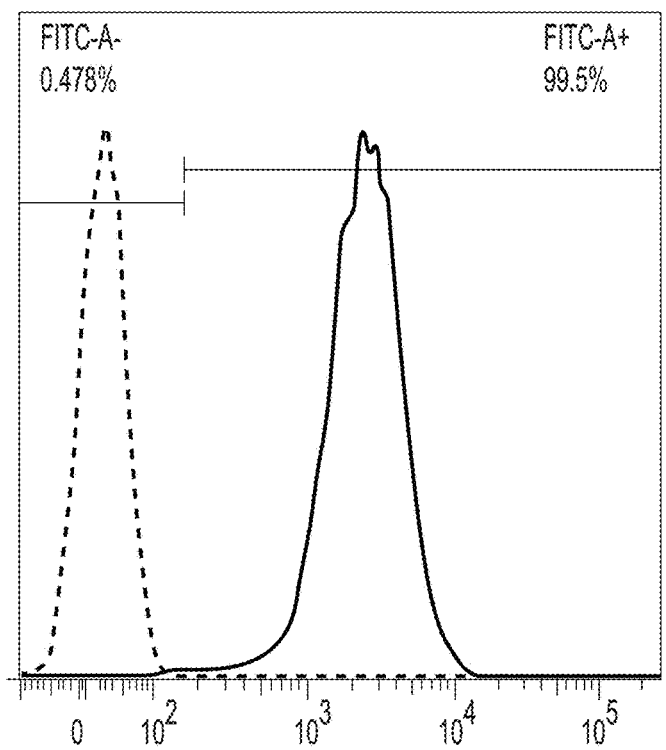

FIG. 37 shows flow cytometry histograms of cynomolgus-CD19 transfected cell line WBP701.CHO-K1.cpro1.FL.C9 and CHO-K1 parental cell line.

Figure 38:
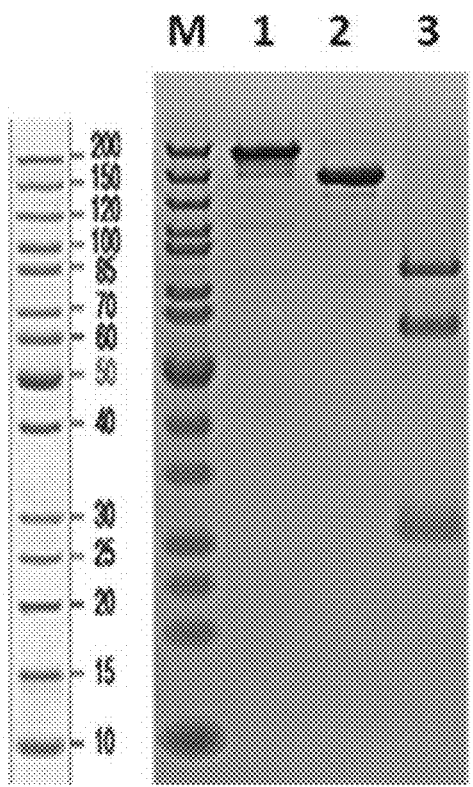

FIG. 38 shows SDS-PAGE of W3438-T3U4.F16-1.uIgG4.SP. M: Protein marker; Lane1: W3438-T3U4.F16-1.uIgG4.SP, non-reduced; Lane3: W3438-T3U4.F16-1.uIgG4.SP, reduced.

Figure 39:
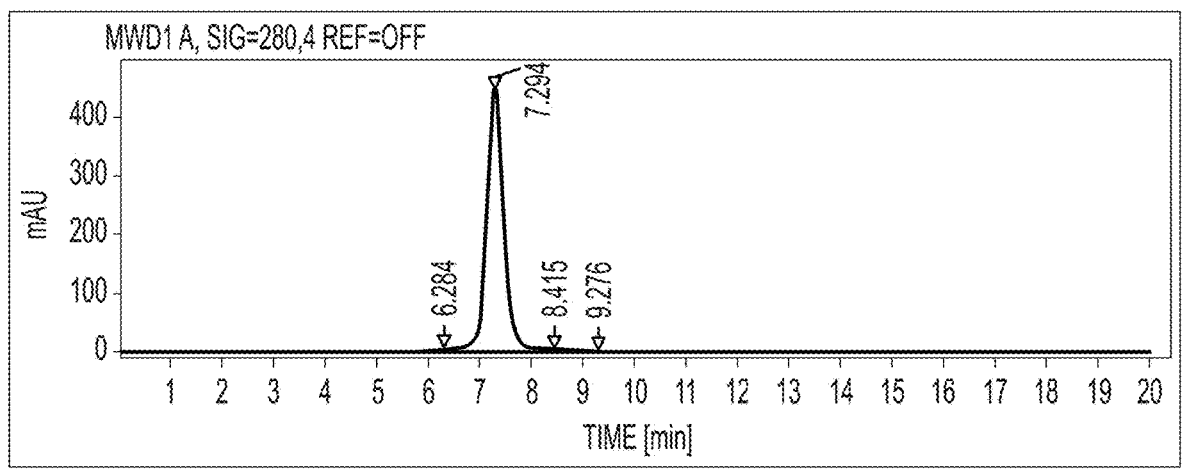

FIG. 39 shows SEC-HPLC of W3438-T3U4.F16-1.uIgG4.

Figure 40:
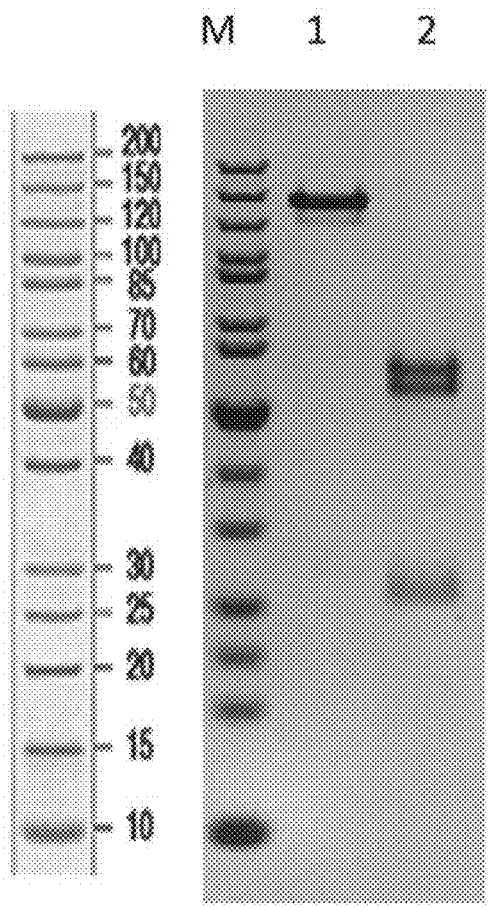

FIG. 40 shows SDS-PAGE of W3438-T3U4.E17-1.uIgG4.SP. M: Protein marker; Lane1: W3438-T3U4.E17-1.uIgG4.SP, non-reduced; Lane2: W3438-T3U4.E17-1.uIgG4.SP, reduced.

Figure 41:
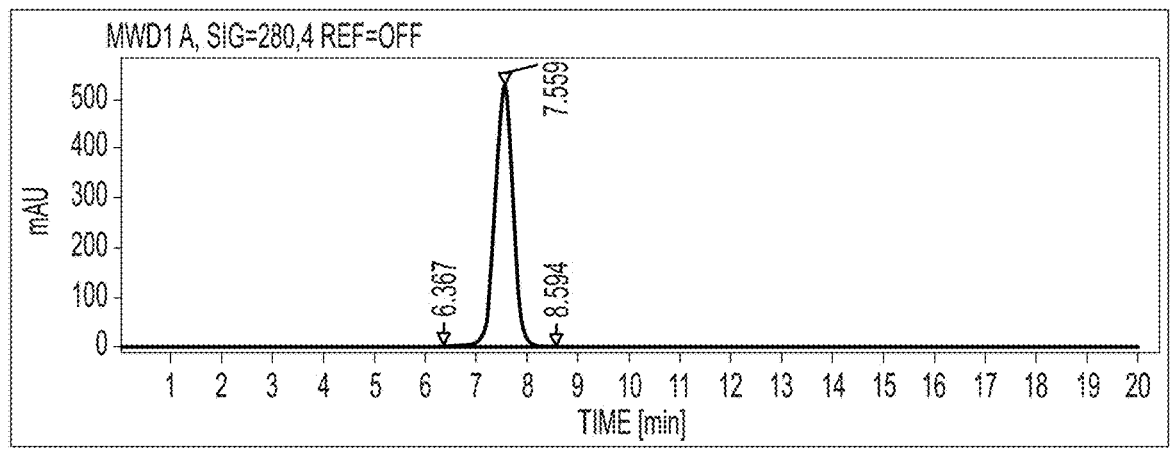

FIG. 41 shows SEC-HPLC of W3438-T3U4.E17-1.uIgG4.SP.

Figure 42A:
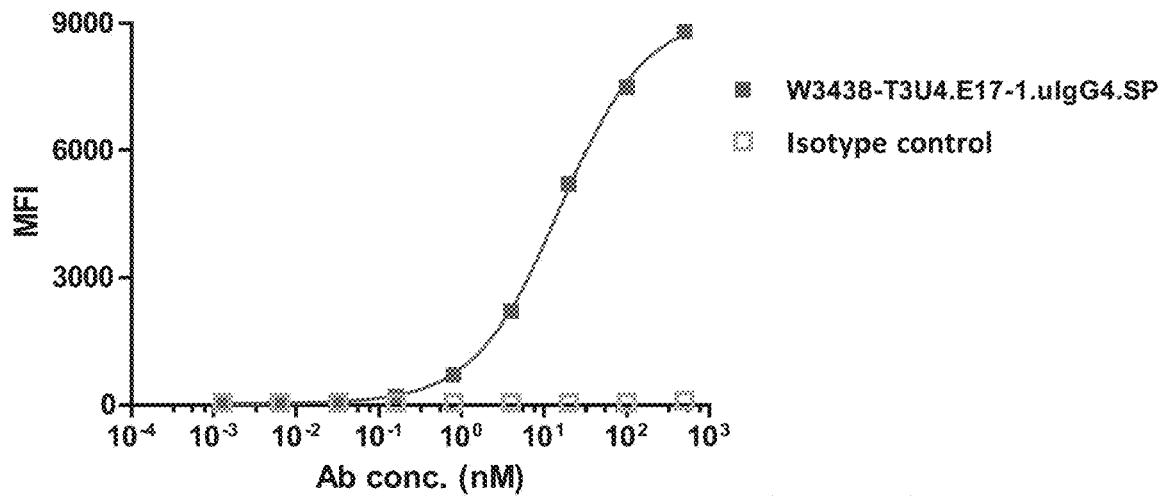
Figure 42B:
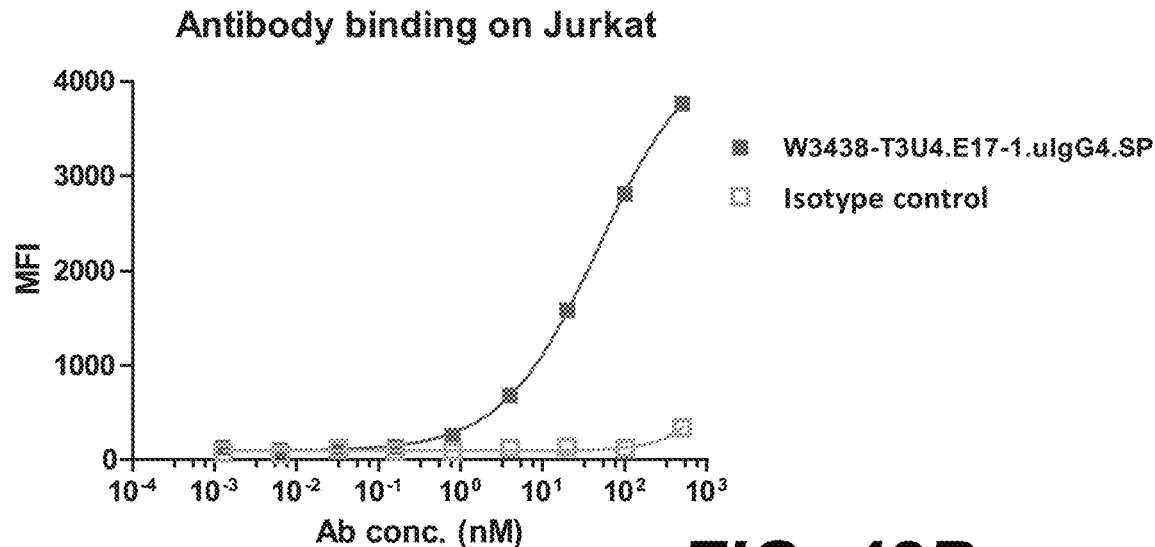

FIGS. 42A-42B show binding of W3438-T3U4.E17-1.uIgG4.SP to Ramos cells (FIG. 42A) and Jurkat cells (FIG. 42B) by FACS.

Figure 43A:
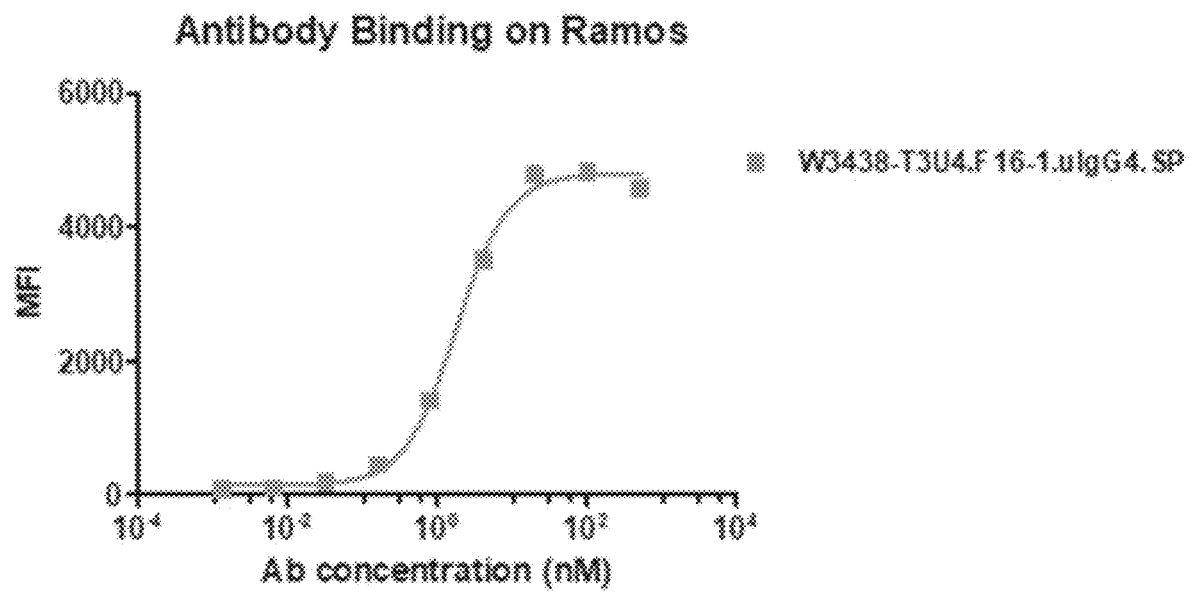
Figure 43B:
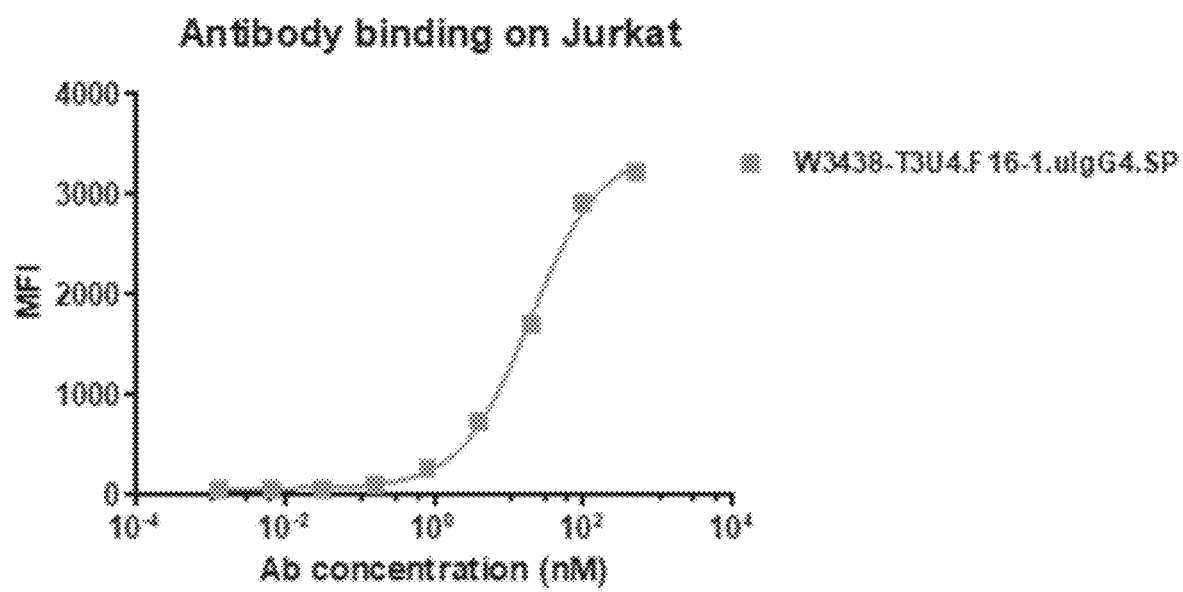

FIGS. 43A-43B show binding of W3438-T3U4.F16-1.uIgG4.SP to Ramos cells (FIG. 43A) and Jurkat cells (FIG. 43B) by FACS.

Figure 44:
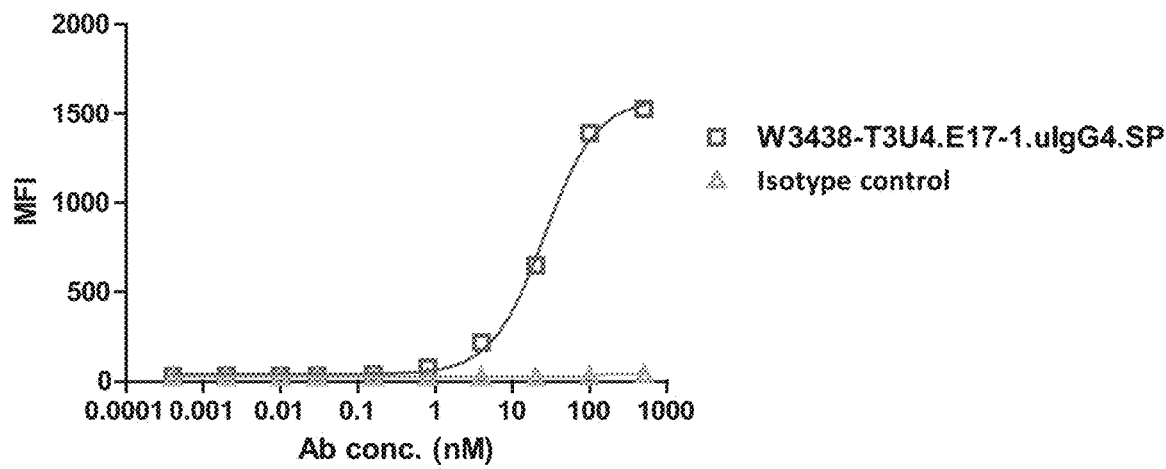

FIG. 44 shows binding of W3438-T3U4.E17-1.uIgG4.SP to cynomolgus-CD19 expressing cell by FACS.

Figure 45:
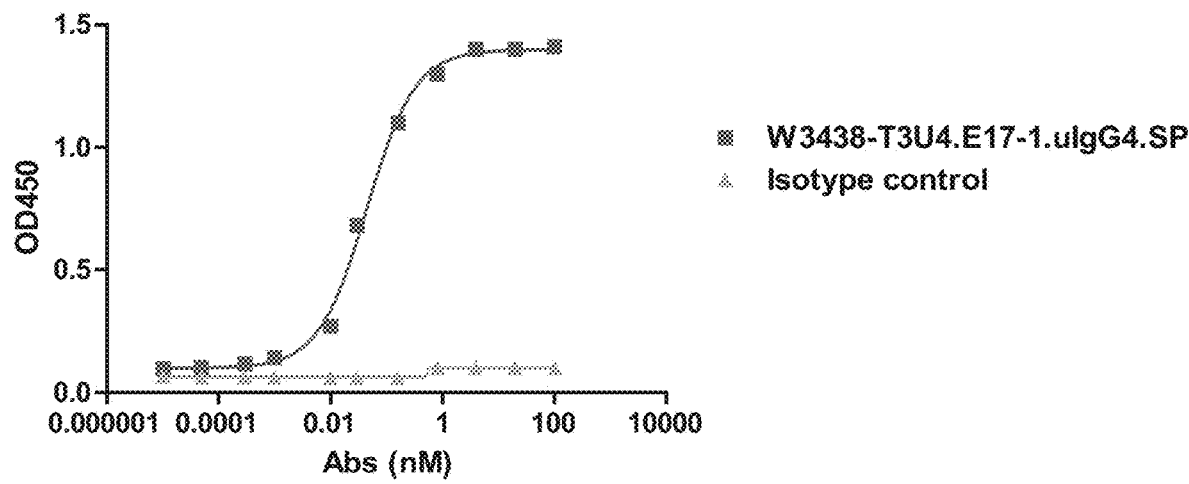

FIG. 45 shows binding of W3438-T3U4.E17-1.uIgG4.SP to cynomolgus CD3 by ELISA.

Figure 46A:
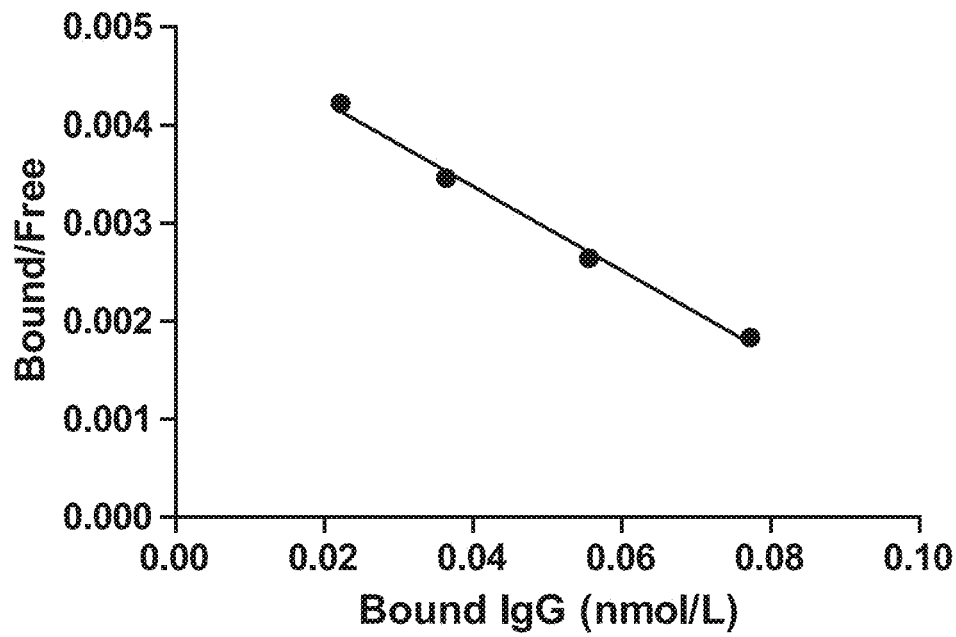
Figure 46B:
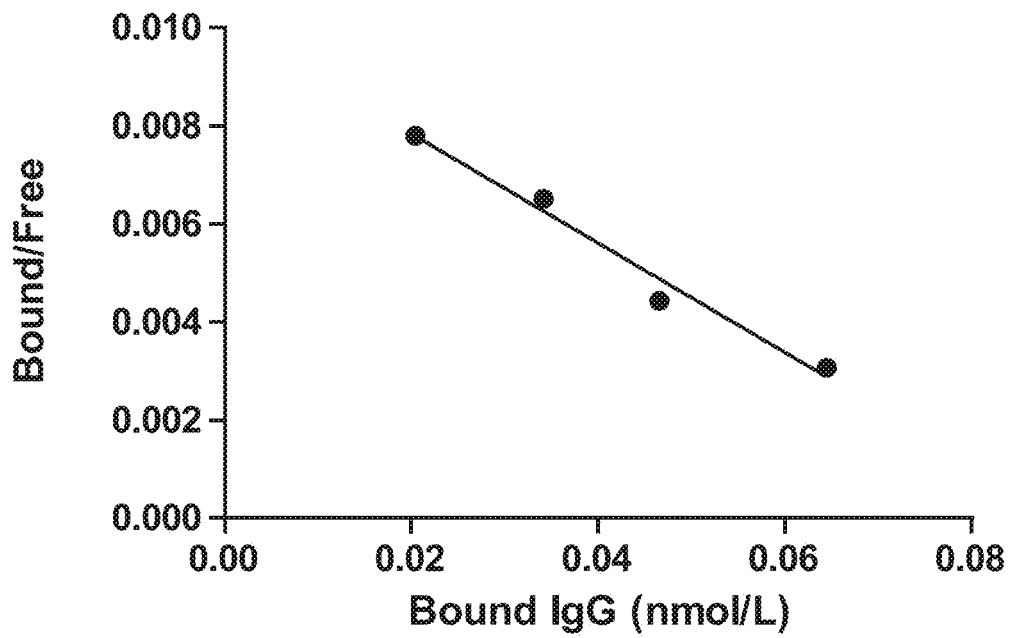

FIGS. 46A-46B show affinity of W3438-T3U4.E17-1.uIgG4.SP to human CD19 and CD3 as measured by binding to Ramos (FIG. 46A) and Jurkat (FIG. 46B) cells.

Figures 47A, 47B:
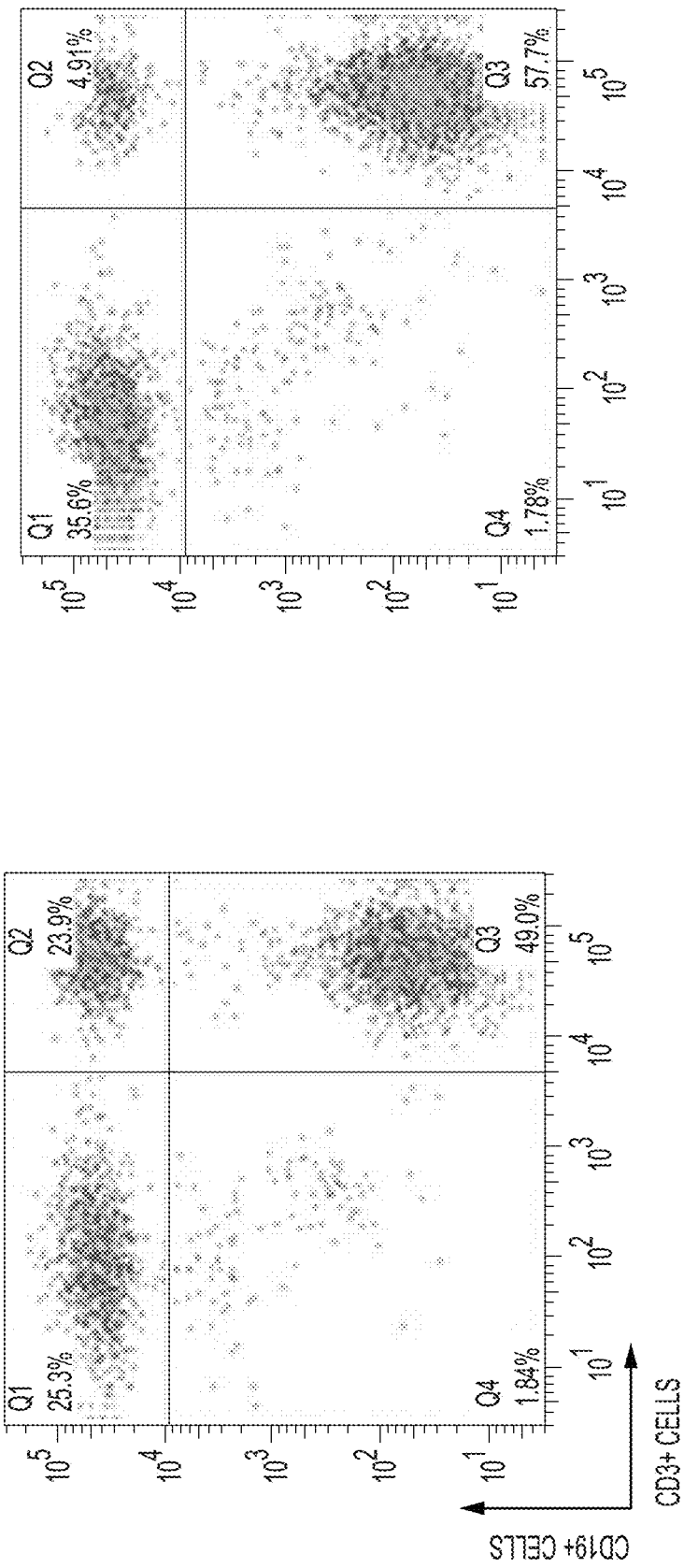

FIGS. 47A-47B show W3438-T3U4.E17-1.uIgG4.SP-mediated CD3+ cells binding to CD19+ cells (FIG. 47A). An irrelevant IgG was used as a negative control (FIG. 47B).

FIGS. 48A-48B show cytotoxic activity of W3438-T3U4.E17-1.uIgG4.SP mediated T cells killing on Raji cell (FIG. 48A) and cytotoxic activity of W3438-T3U4.F16-1.uIgG4.SP mediated T cells killing on Raji cell (FIG. 48B).

Figure 49A:
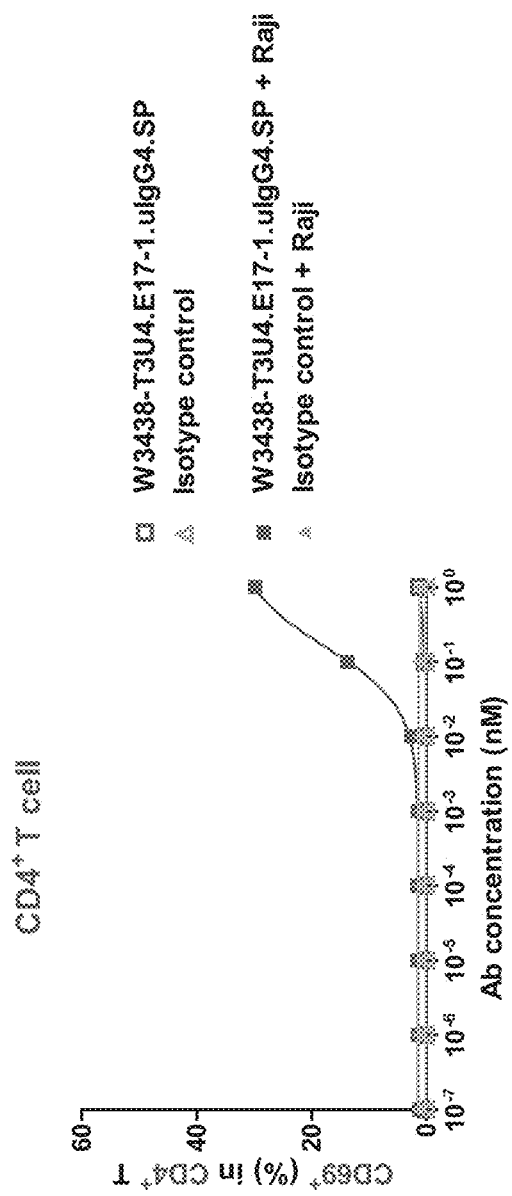
Figure 49B:
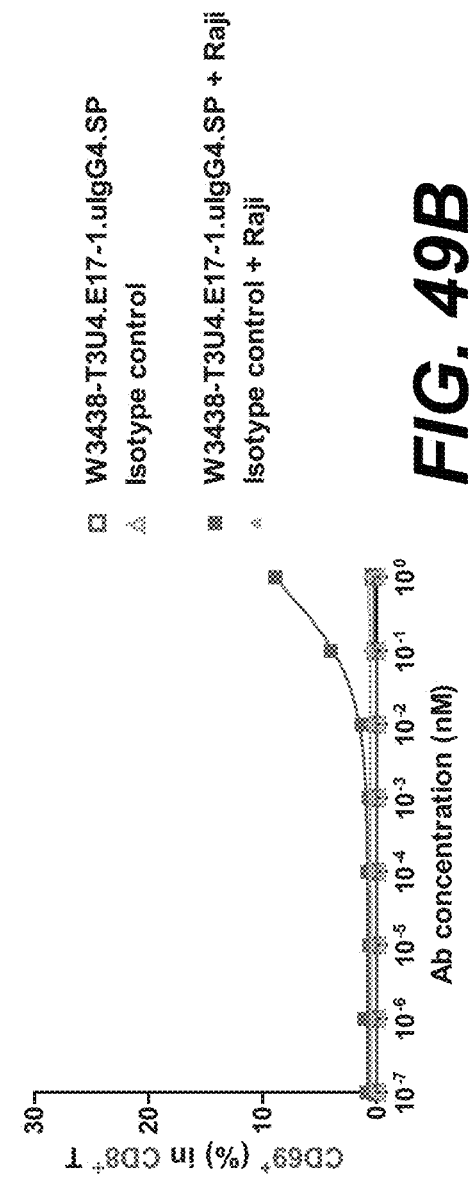

FIGS. 49A-49D show CD69 and CD25 expression on T cell in the presence or absence of CD19+ target cells. Percentage of CD69+ expression T cell in CD4+ T cell subset (FIG. 49A); Percentage of CD69 expression T cell in CD8+ T cell subset (FIG. 49B); Percentage of CD25 expression T cell in CD4+ T cell subset (FIG. 49C); Percentage of CD25 expression T cell in CD8+ T cell subset (FIG. 49D).

FIGS. 50A-50D show IFN-γ and TNF-α cytokine release of T cell in the presence or absence of CD19+ target cells. Release of IFN-γ in CD4+ T cell subset (FIG. 50A); Release of TNF-α in CD4+ T cell subset (FIG. 50B); Release of IFN-γ in CD8+ T cell subset (FIG. 50C); Release of TNF-α in CD8+ T cell subset (FIG. 50D).

Figure 51A:
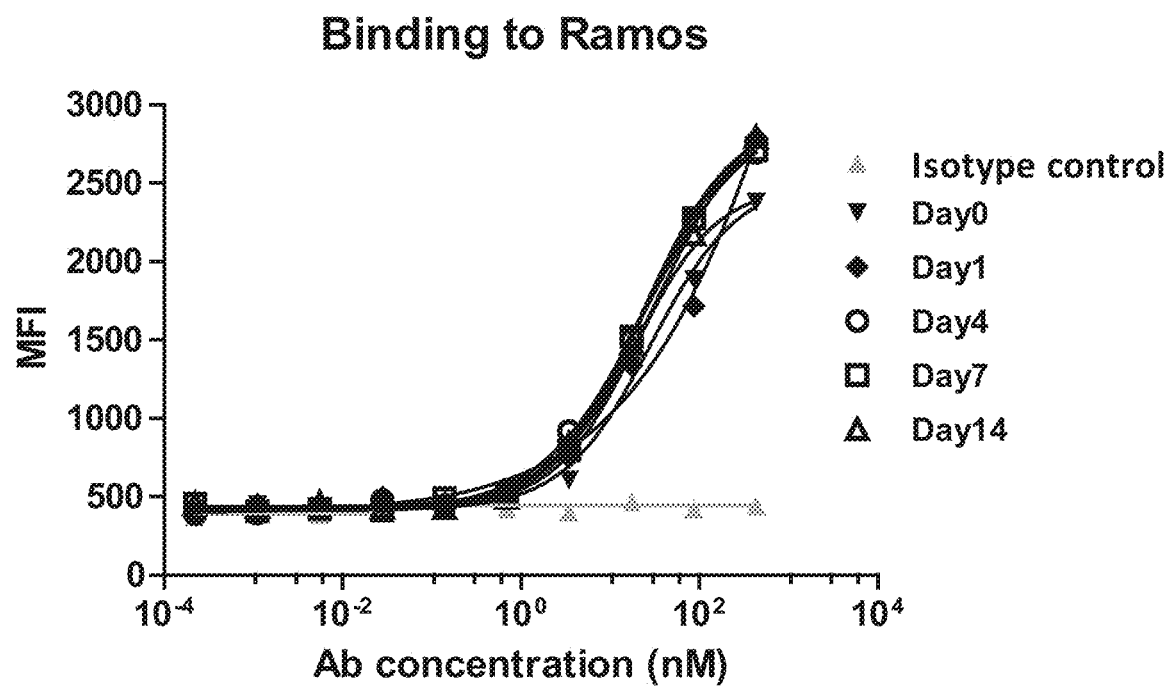
Figure 51B:
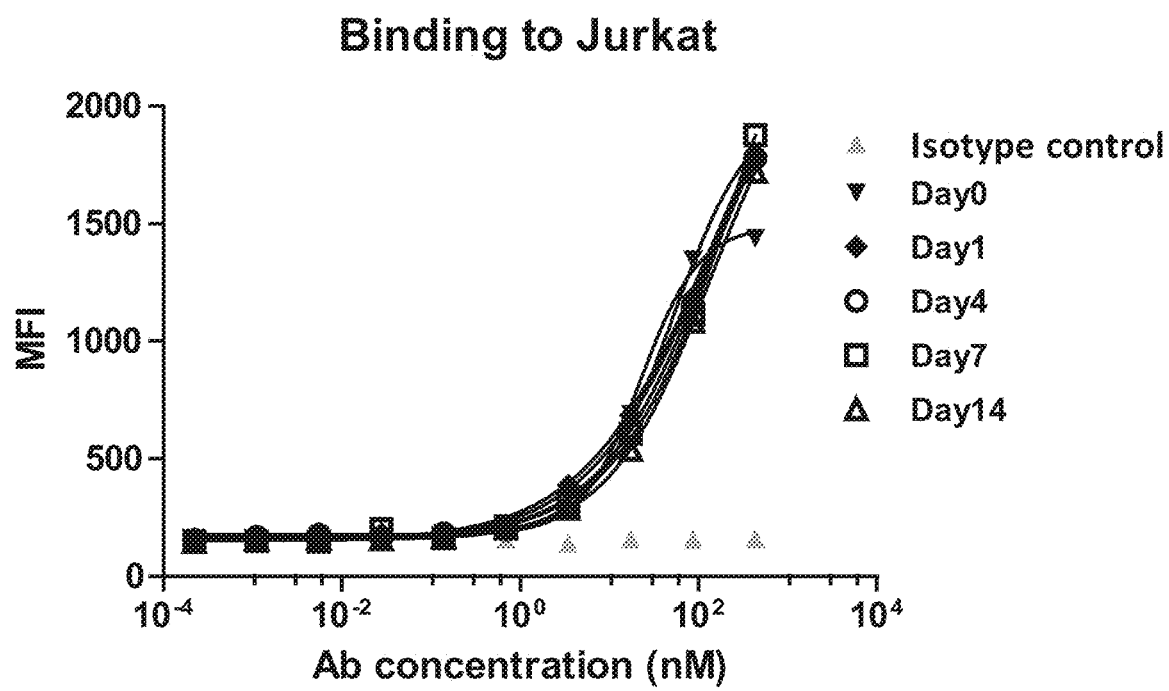

FIGS. 51A-51B show stability of W3438-T3U4.E17-1.uIgG4.SP in human serum. Binding of W3438-T3U4.E17-1.uIgG4.SP samples incubated in serum to Ramos at indicated days (FIG. 51A); Binding of serum incubated W3438-T3U4.E17-1.uIgG4.SP samples to Jurkat at indicated days (FIG. 51B).

Figure 52:
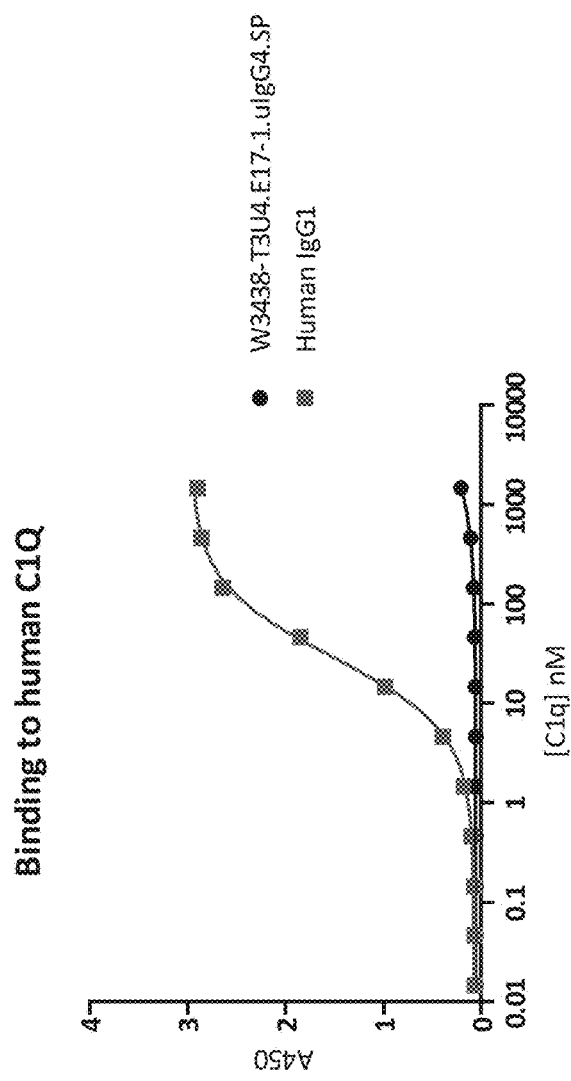

FIG. 52 shows binding of W3438-T3U4.E17-1.uIgG4.SP to C1Q by ELISA. An IgG1 antibody was used as the control.

Figure 53:
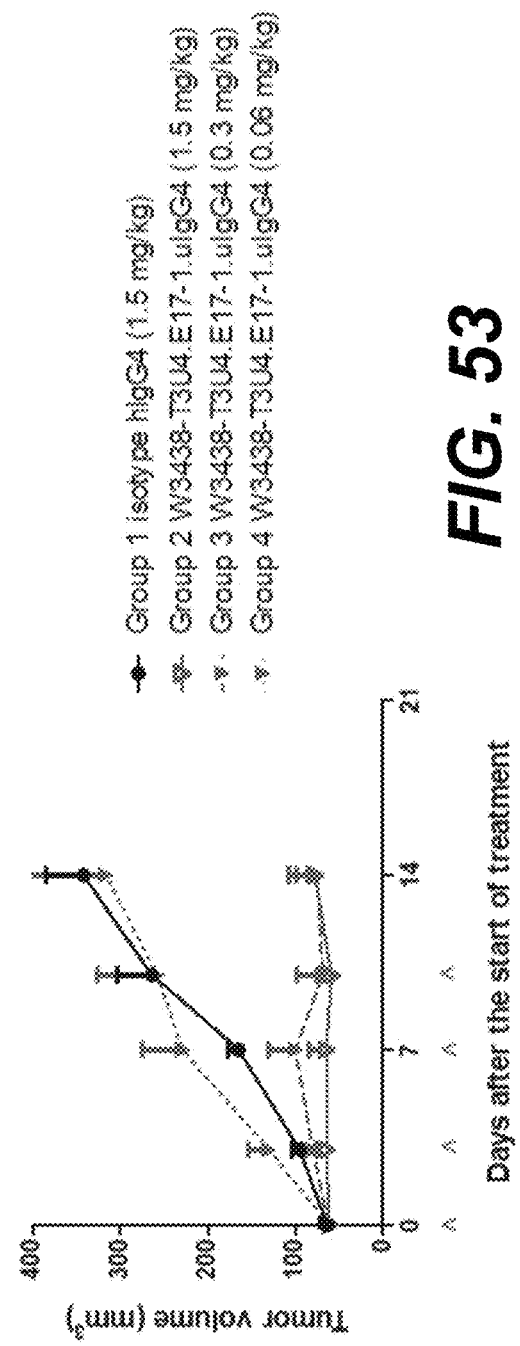

FIG. 53 shows tumor volume trace after administering W3438-T3U4.E17-1.uIgG4.SP at different doses to admixed PBMC humanized mice bearing Raji xenografts tumors. Data points represent group mean, and error bars represent standard error of the mean (SEM). An IgG4 antibody was used as a negative control.

Figure 54:
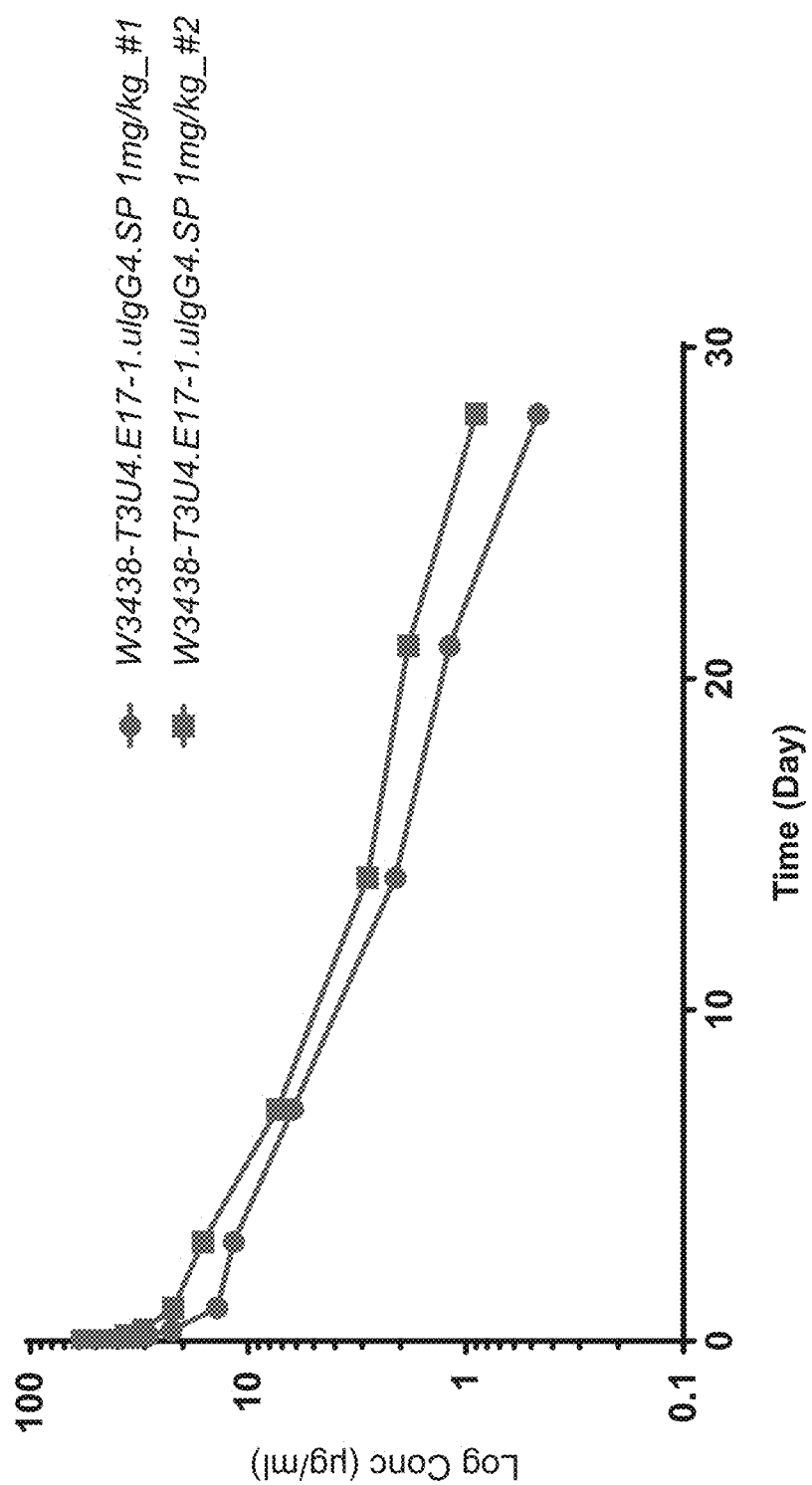

FIG. 54 shows pharmacokinetics of W3438-T3U4.E17-1.uIgG4.SP in cynomolgus monkey. The serum samples from two monkeys were detected by ELISA.

Figure 55A:
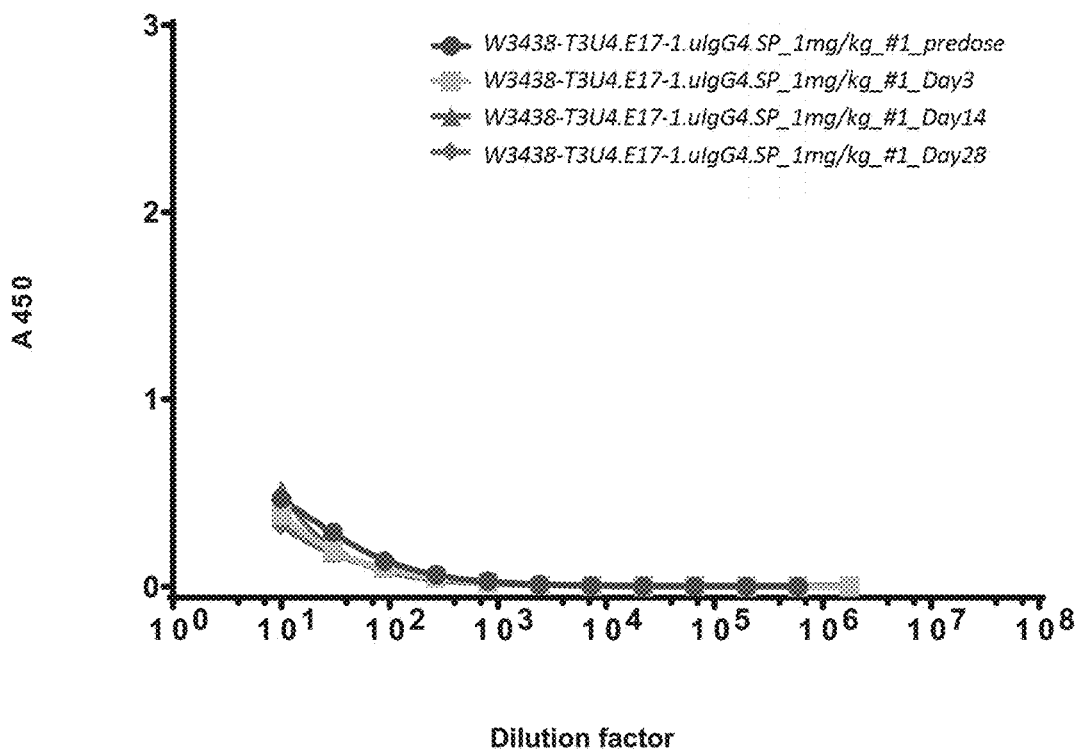
Figure 55B:
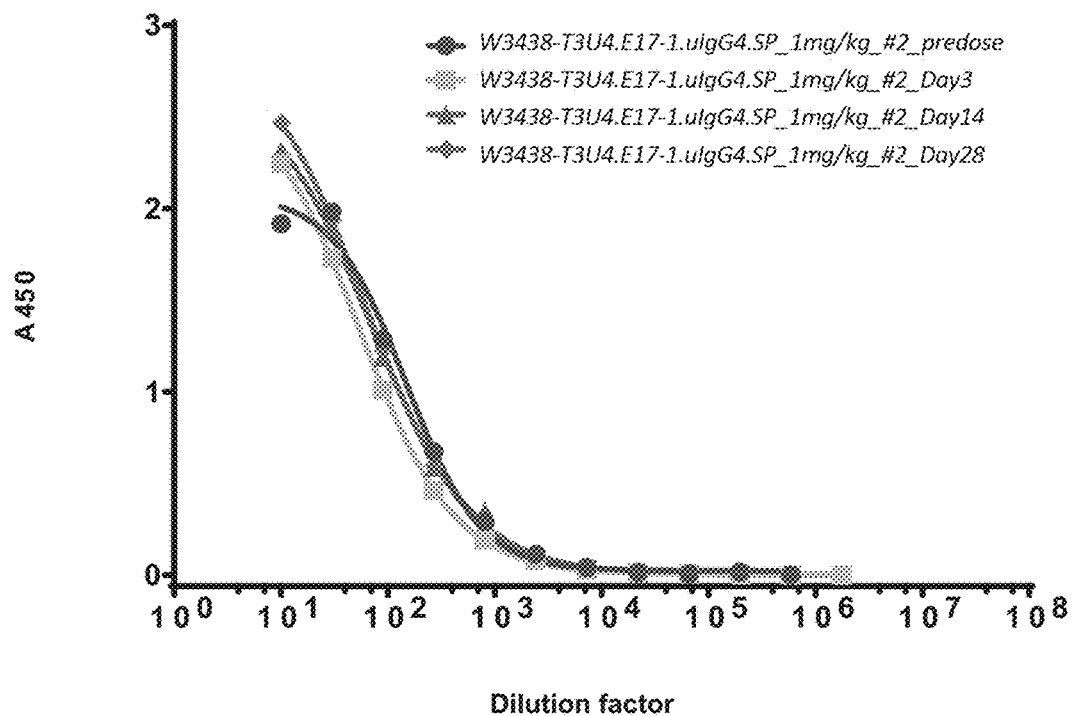

FIGS. 55A-55B show the anti-drug antibody (ADA detected by ELISA) in serum samples from monkey #1 (FIG. 55A) and monkey #2 (FIG. 55B), including both predose and postdose of W3438-T3U4.E17-1.uIgG4.SP.

Figure 56A:
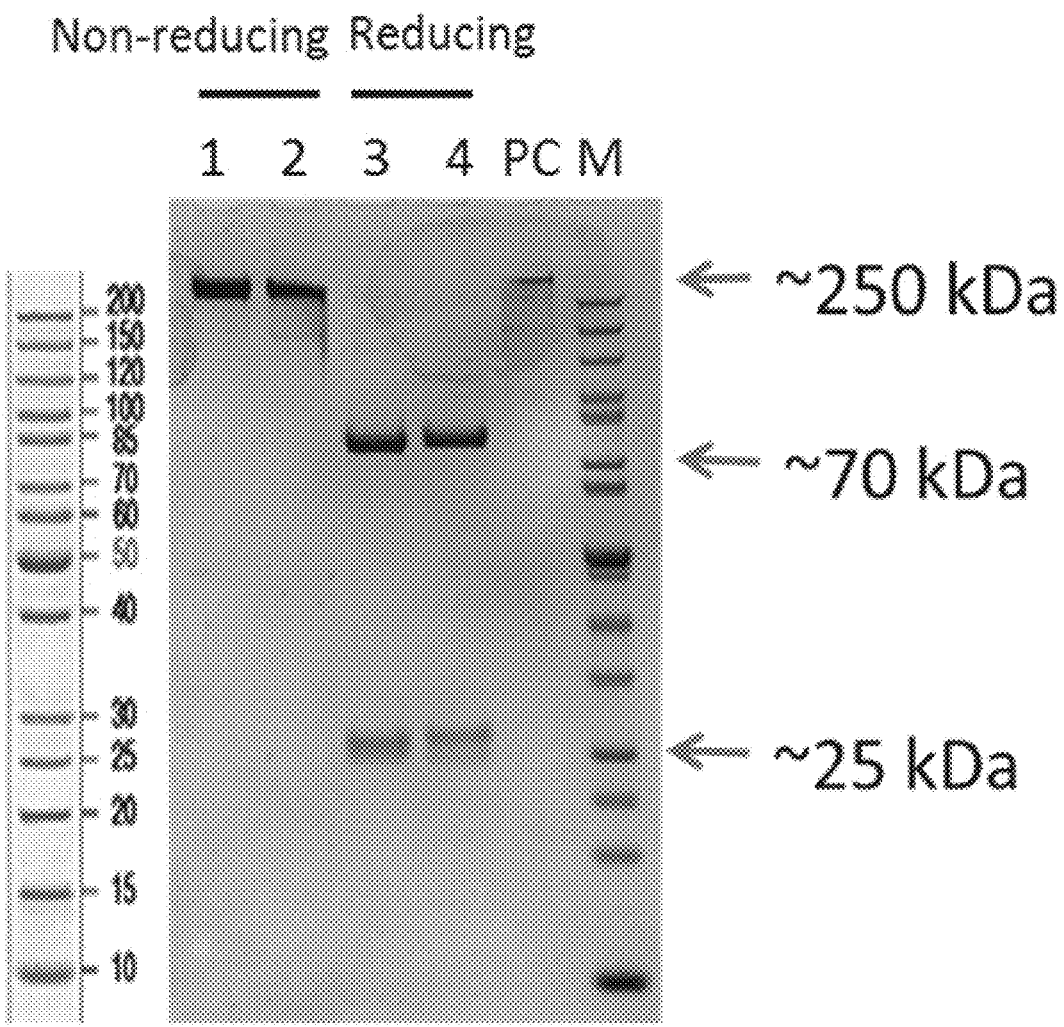

FIGS. 56A-56B show SDS-PAGE characterizations of W3248-U6T5.G25-1.uIgG4.SP and W3248-U6T1.G25R-1.uIgG4.SP. M: Protein marker. PC: a positive control of a bispecific antibody at around 250 kDa (FIG. 56A) and SEC-HPLC characterizations of W3248-U6T1.G25R-1.uIgG4.SP and W3248-U6T5.G25-1.uIgG4.SP (FIG. 56B).

FIG. 57 shows melting temperatures of W3248-U6T1.G25R-1.uIgG4.SP, W3248-U6T5.G25-1.uIgG4.SP, and a benchmark bispecific anti-CTLA-4×PD-1 antibody WBP324-BMK1.uIgG1.KDL.

Figure 58:
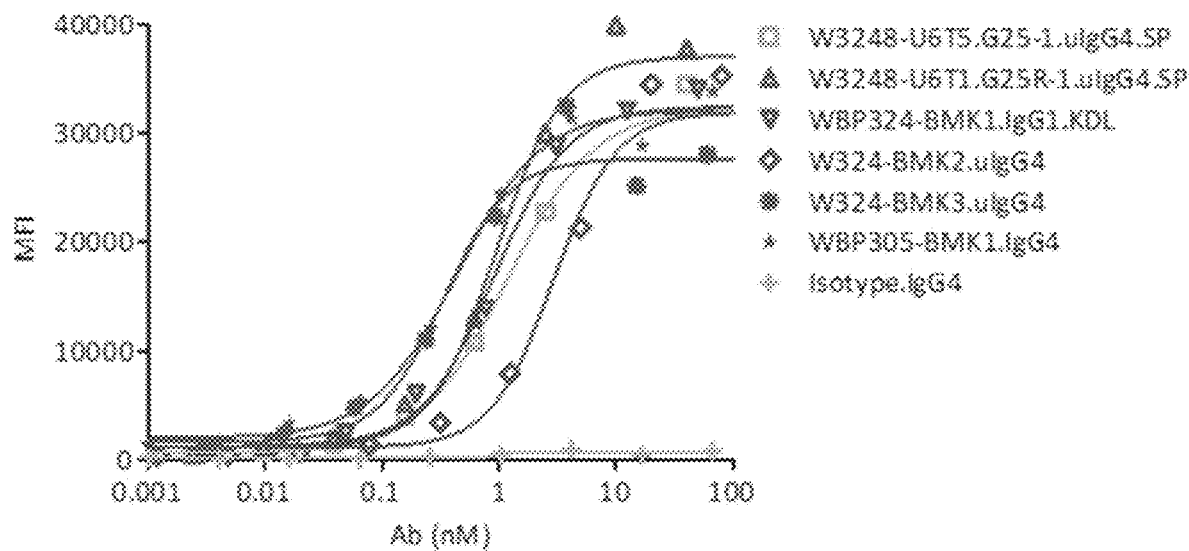

FIG. 58 shows FACS bindings of W3248-U6T5.G25-1.uIgG4.SP and W3248-U6T1.G25R-1.uIgG4.SP to human PD-1 engineered cells. WBP324-BMK1.uIgG1.KDL, W324-BMK2.uIgG4, and W324-BMK3.uIgG4 are different versions of benchmark bispecific anti-CTLA-4×PD-1 antibodies. WBP305-BMK1.IgG4 is an anti-PD-1 antibody. An IgG4 antibody was used as the negative control.

Figure 59:
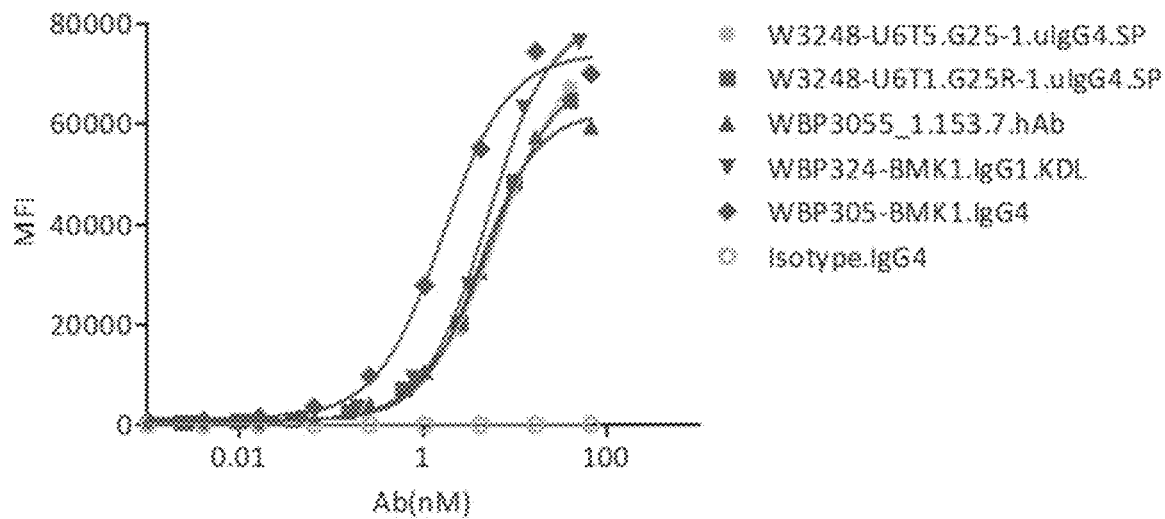

FIG. 59 shows FACS bindings of W3248-U6T5.G25-1.uIgG4.SP and W3248-U6T1.G25R-1.uIgG4.SP to cynomolgus PD-1 engineered cells. WBP3055_1.153.7.hAb and WBP305-BMK1.IgG4 are anti-PD-1 antibodies. An IgG4 antibody was used as the negative control.

Figure 60:
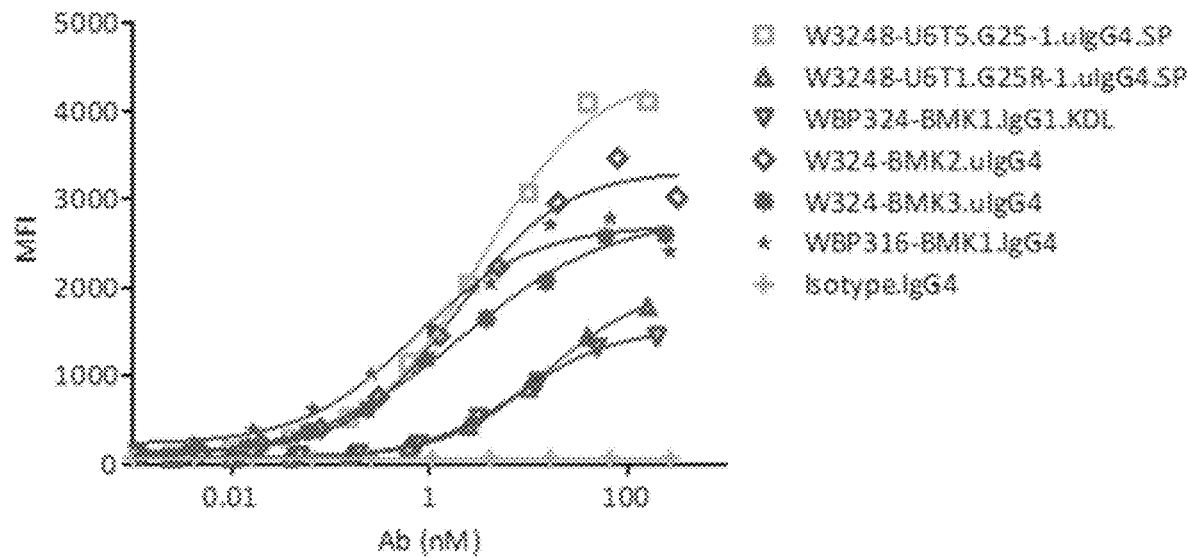

FIG. 60 shows FACS bindings of W3248-U6T5.G25-1.uIgG4.SP and W3248-U6T1.G25R-1.uIgG4.SP to human CTLA-4 engineered cells. WBP324-BMK1.uIgG1.KDL, W324-BMK2.uIgG4, and W324-BMK3.uIgG4 are different benchmark bispecific anti-CTLA-4×PD-1 antibodies. WBP316-BMK1.IgG4 is an anti-CTLA-4-1 antibody. An IgG4 antibody was used as the negative control.

Figure 61:
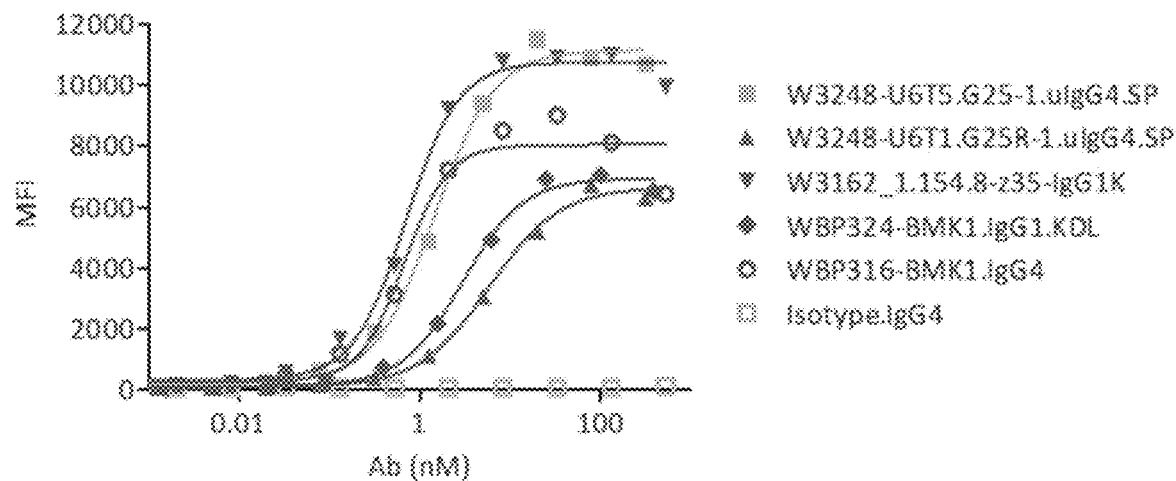

FIG. 61 shows FACS bindings of W3248-U6T5.G25-1.uIgG4.SP and W3248-U6T1.G25R-1.uIgG4.SP to cynomolgus CTLA-4 engineered cells. WBP324-BMK1.uIgG1.KDL is a benchmark bispecific anti-CTLA-4×PD-1 antibody. W3162_1.154.8-z35-IgG1K and WBP316-BMK1.IgG4 are anti-CTLA-4 antibodies. An IgG4 antibody was used as the negative control.

FIG. 62 summarizes binding affinities of W3248-U6T5.G25-1.uIgG4.SP and W3248-U6T1.G25R-1.uIgG4.SP to CTLA-4 and PD-1, as measured by SPR. WBP316-BMK1.IgG4 is an anti-CTLA-4-1 antibody. A parent antibody of anti-PD-1 was used as a control.

Figure 63:
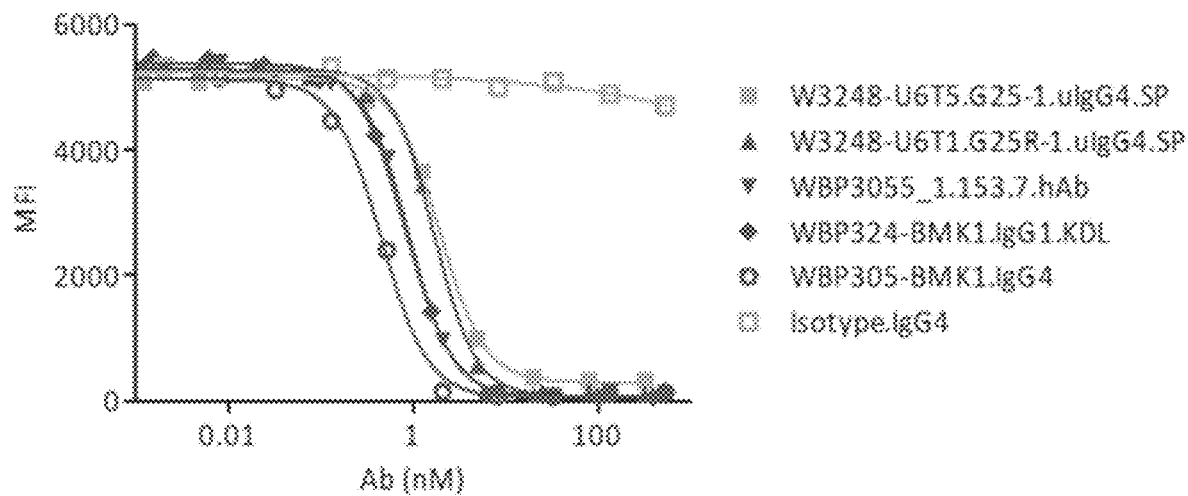

FIG. 63 shows FACS competition assays of W3248-U6T5.G25-1.uIgG4.SP and W3248-U6T1.G25R-

1.uIgG4.SP to block human PD-L1 protein binding to PD-1 engineered cells. WBP324-BMK1.uIgG1.KDL is a benchmark bispecific anti-CTLA-4×PD-1 antibody. WBP3055_1.153.7.hAb and WBP305-BMK1.IgG4 are anti-PD-1 antibodies. An IgG4 antibody was used as the negative control.

Figure 64:
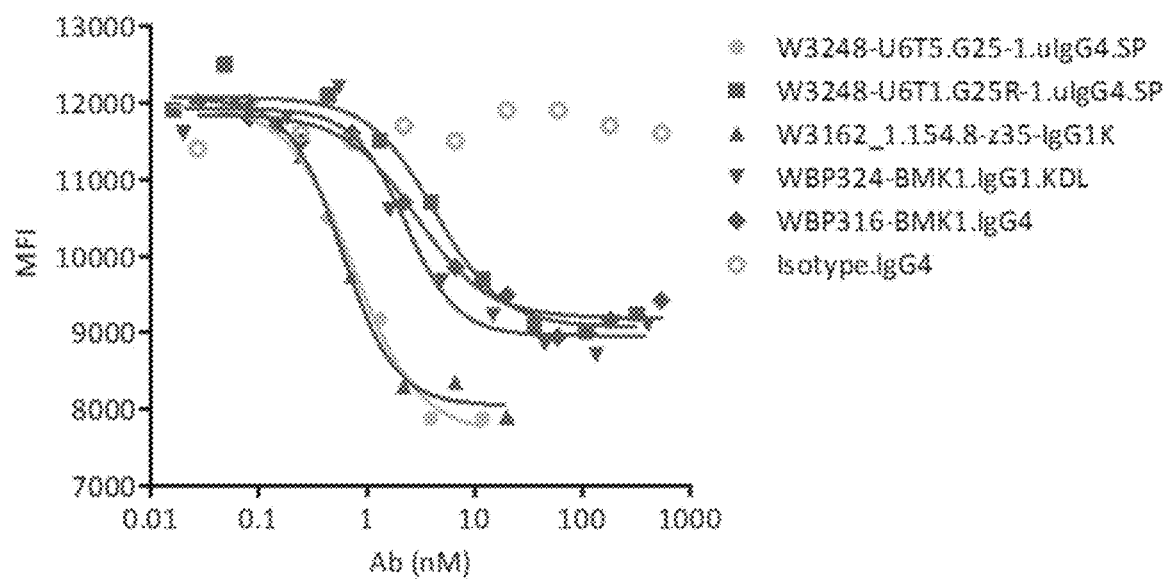

FIG. 64 shows FACS competition assays of W3248-U6T5.G25-1.uIgG4.SP and W3248-U6T1.G25R-1.uIgG4.SP to block human CTLA-4 protein binding to CD80 engineered cells. WBP324-BMK1.uIgG1.KDL is a benchmark bispecific anti-CTLA-4×PD-1 antibody. W3162_1.154.8-z35-IgG1K and WBP316-BMK1.IgG4 are anti-CTLA-4 antibodies. An IgG4 antibody was used as the negative control.

Figure 65:
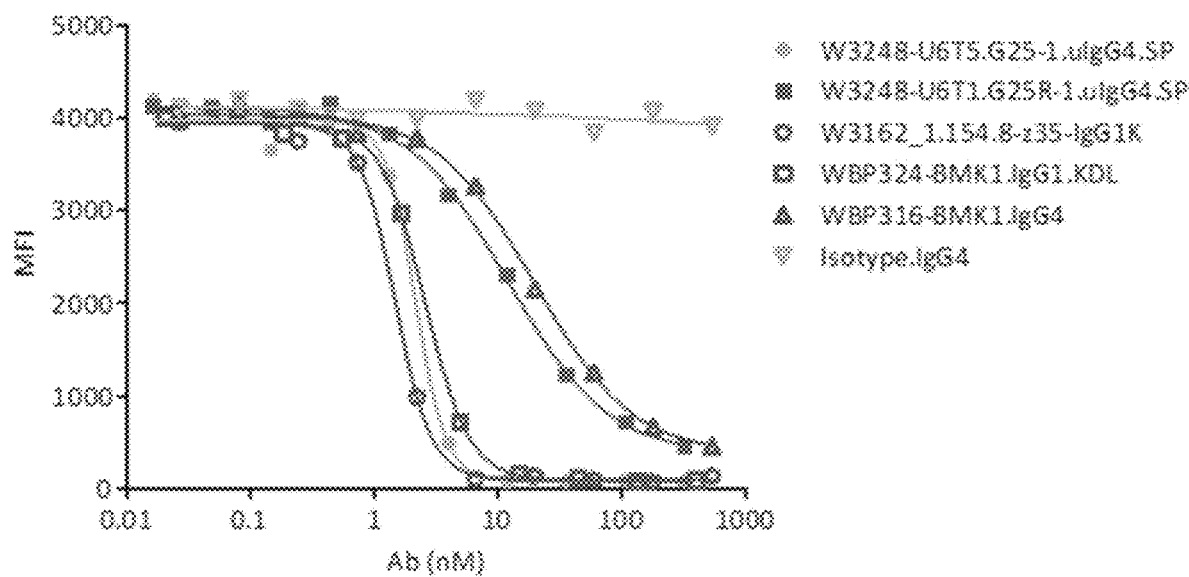

FIG. 65 shows FACS competition assays of W3248-U6T5.G25-1.uIgG4.SP and W3248-U6T1.G25R-1.uIgG4.SP to block cynomolgus CTLA-4 protein binding to CD80 engineered cells. WBP324-BMK1.uIgG1.KDL is a benchmark bispecific anti-CTLA-4×PD-1 antibody. W3162_1.154.8-z35-IgG1K and WBP316-BMK1.IgG4 are anti-CTLA-4 antibodies. An IgG4 antibody was used as the negative control.

Figure 66:
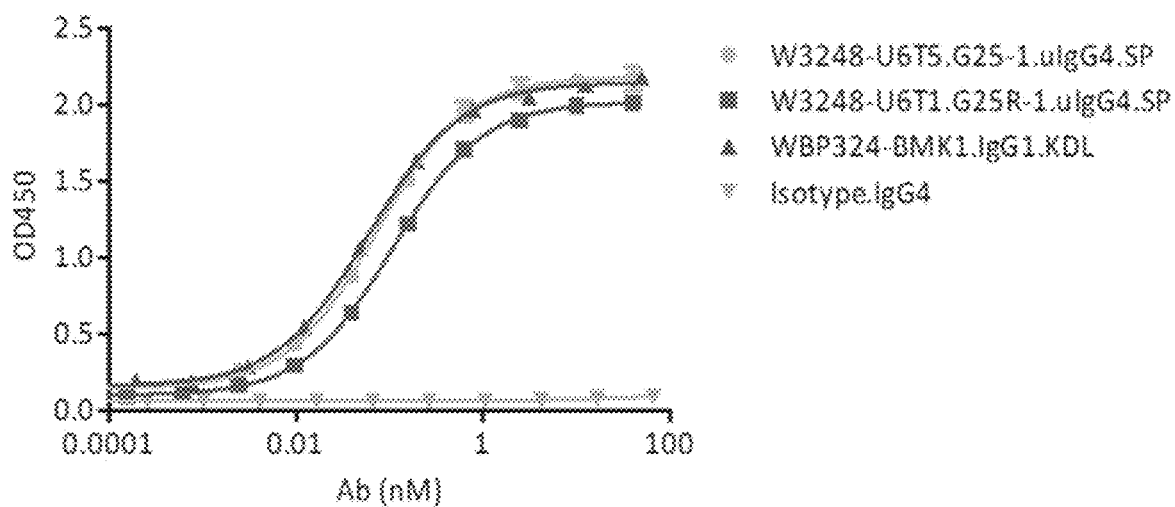

FIG. 66 shows ELISA dual binding assay of W3248-U6T5.G25-1.uIgG4.SP and W3248-U6T1.G25R-1.uIgG4.SP. WBP324-BMK1.uIgG1.KDL is a benchmark bispecific anti-CTLA-4×PD-1 antibody. An IgG4 antibody was used as the negative control.

Figure 67:
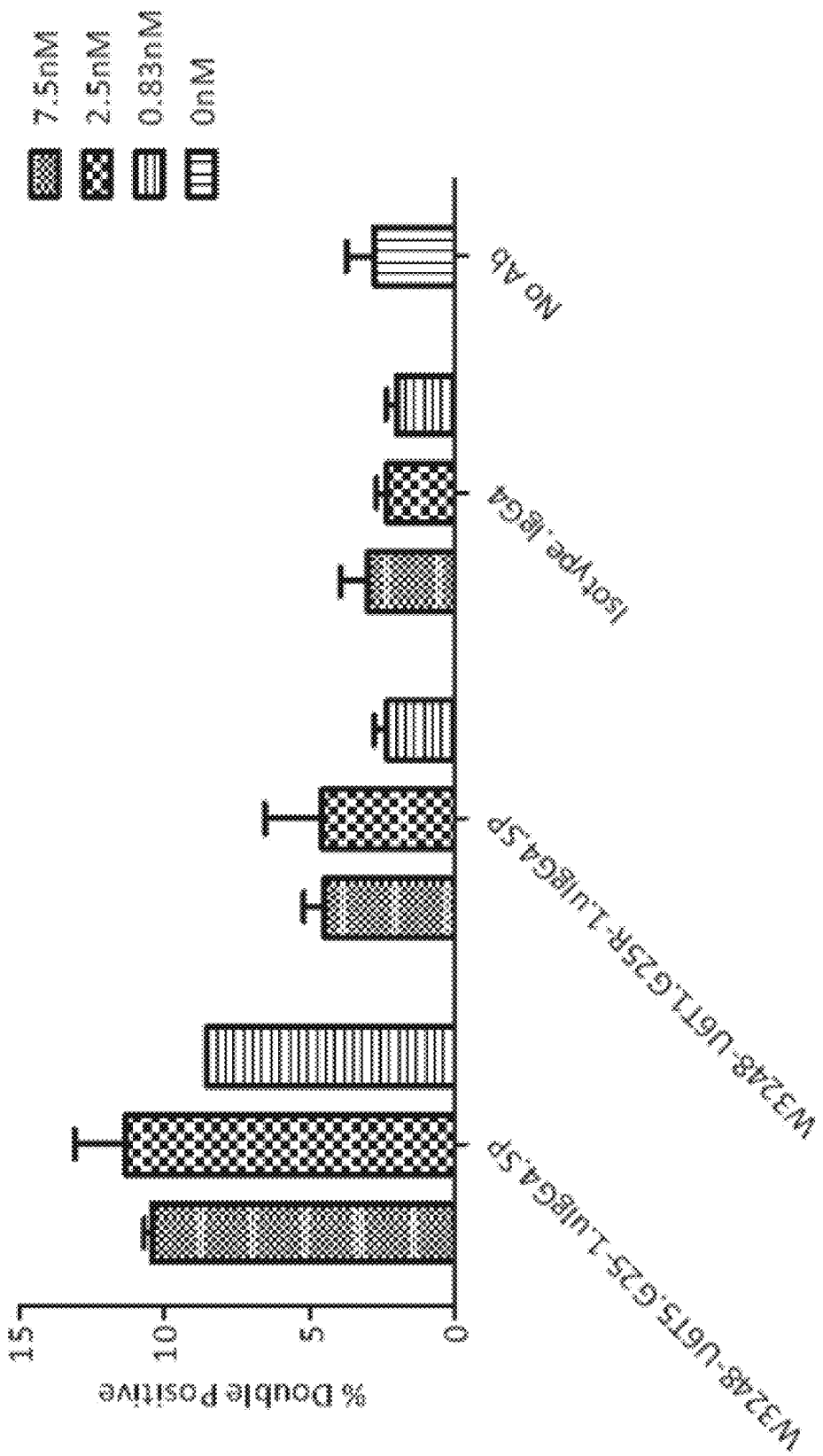

FIG. 67 shows FACS dual binding of W3248-U6T5.G25-1.uIgG4.SP and W3248-U6T1.G25R-1.uIgG4.SP to CTLA-4 and PD-1. An IgG4 antibody was used as the negative control.

Figure 68A:
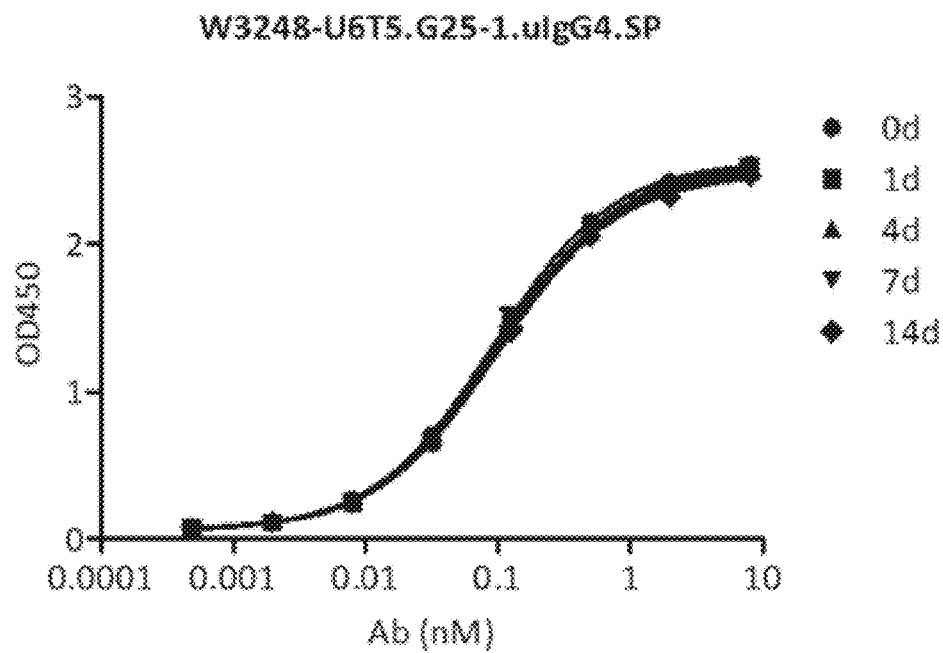
Figure 68B:
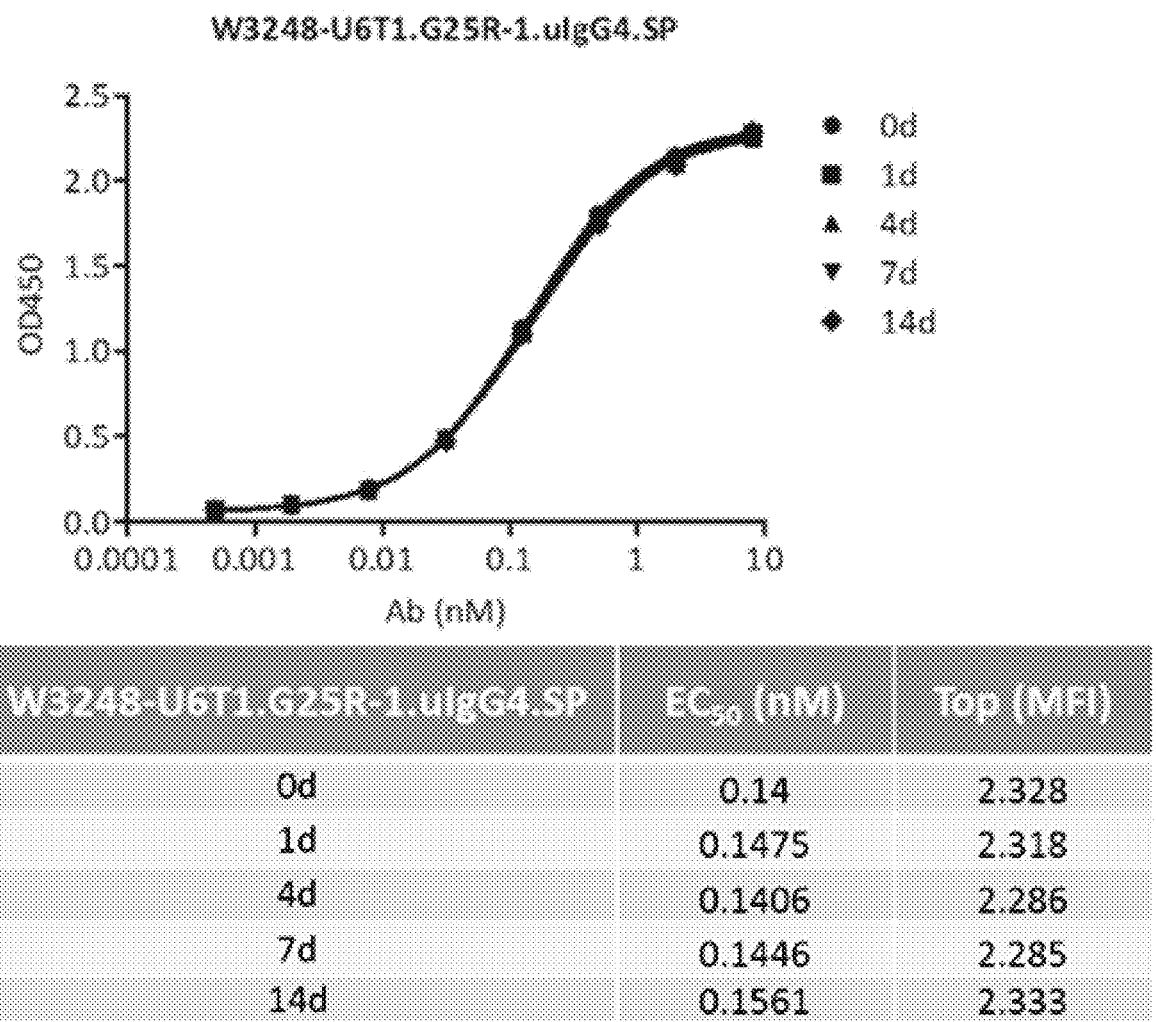

FIGS. 68A-68B show stability of W3248-U6T5.G25-1.uIgG4.SP in serum for 14 days, as measured by ELISA dual binding to human CTLA-4 and PD-1 (FIG. 68A) and stability of W3248-U6T1.G25R-1.uIgG4.SP in serum for 14 days, as measured by ELISA dual binding to human CTLA-4 and PD-1 (FIG. 68B).

DETAILED DESCRIPTION OF THE INVENTION

The following description of the disclosure is merely intended to illustrate various embodiments of the disclosure. As such, the specific modifications discussed are not to be construed as limitations on the scope of the disclosure. It will be apparent to one skilled in the art that various equivalents, changes, and modifications may be made without departing from the scope of the disclosure, and it is understood that such equivalent embodiments are to be included herein. All references cited herein, including publications, patents and patent applications are incorporated herein by reference in their entirety.

Definitions

The articles "a," "an," and "the" are used herein to refer to one or to more than one (i.e., to at least one) of the grammatical object of the article. By way of example, "a polypeptide complex" means one polypeptide complex or more than one polypeptide complex.

As used herein, the term "about" or "approximately" refers to a quantity, level, value, number, frequency, percentage, dimension, size, amount, weight or length that varies by as much as 30, 25, 20, 25, 10, 9, 8, 7, 6, 5, 4, 3, 2 or 1% to a reference quantity, level, value, number, frequency, percentage, dimension, size, amount, weight or length. In particular embodiments, the terms "about" or "approximately" when preceding a numerical value indicates the value plus or minus a range of 15%, 10%, 5%, or 1%.

Throughout this disclosure, unless the context requires otherwise, the words "comprise", "comprises" and "comprising" will be understood to imply the inclusion of a stated step or element or group of steps or elements but not the exclusion of any other step or element or group of steps or elements. By "consisting of" is meant including, and limited to, whatever follows the phrase "consisting of". Thus, the phrase "consisting of" indicates that the listed elements are required or mandatory, and that no other elements may be present. By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

Reference throughout this disclosure to "one embodiment," "an embodiment," "a particular embodiment," "a related embodiment," "a certain embodiment," "an additional embodiment," or "a further embodiment" or combinations thereof means that a particular feature, structure or characteristic described in connection with the embodiment is included in at least one embodiment of the present disclosure. Thus, the appearances of the foregoing phrases in various places throughout this specification are not necessarily all referring to the same embodiment. Furthermore, the particular features, structures, or characteristics may be combined in any suitable manner in one or more embodiments.

The terms "polypeptide," "peptide," and "protein" are used interchangeably herein to refer to a polymer of amino acid residues, or an assembly of multiple polymers of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymer. The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, gamma-carboxyglutamate, and O-phosphoserine. Amino acid analogs refer to compounds that have the same basic chemical structure as a naturally occurring amino acid, i.e., an alpha-carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. An alpha-carbon refers to the first carbon atom that attaches to a functional group, such as a carbonyl. A beta-carbon refers to the second carbon atom linked to the alpha-carbon, and the system continues naming the carbons in alphabetical order with Greek letters. Amino acid mimetics refers to chemical compounds that have a structure that is different from the general chemical structure of an amino acid, but that functions in a manner similar to a naturally occurring amino acid. The term "protein" typically refers to large polypeptides. The term "peptide" typically refers to short polypeptides. Polypeptide sequences are usually described as the left-hand end of a polypeptide sequence is the amino-terminus (N-terminus); the right-hand end of a polypeptide sequence is the carboxyl-terminus (C-terminus). "Polypeptide complex" as used herein refers to a complex comprising one or more polypeptides that are associated to perform certain functions. In certain embodiments, the polypeptides are immune-related.

The term "antibody" as used herein encompasses any immunoglobulin, monoclonal antibody, polyclonal antibody, multispecific antibody, or bispecific (bivalent) antibody that binds to a specific antigen. A native intact antibody comprises two heavy chains and two light chains. Each heavy chain consists of a variable region ("HCVR") and a first, second, and third constant region (CH1, CH2 and CH3), while each light chain consists of a variable region ("LCVR") and a constant region (CL). Mammalian heavy chains are classified as α, δ, ε, γ, and μ, and mammalian light chains are classified as λ or κ. The antibody has a "Y" shape, with the stem of the Y consisting of the second and third constant regions of two heavy chains bound together via disulphide bonding. Each arm of the Y includes the variable region and first constant region of a single heavy chain bound to the variable and constant regions of a single light chain. The variable regions of the light and heavy chains are responsible for antigen binding. The variable regions in both chains generally contain three highly variable loops called the complementarity determining regions (CDRs) (light (L) chain CDRs including LCDR1, LCDR2, and LCDR3, heavy (H) chain CDRs including HCDR1, HCDR2, HCDR3). CDR boundaries for antibodies may be defined or identified by the conventions of Kabat, Chothia, or Al-Lazikani (Al-Lazikani, B., Chothia, C., Lesk, A. M., J. Mol. Biol., 273(4), 927 (1997); Chothia, C. et al., J Mol. Biol. December 5; 186(3):651-63 (1985); Chothia, C. and Lesk, A. M., J. Mol. Biol., 196,901 (1987); Chothia, C. et al., Nature. December 21-28; 342(6252):877-83 (1989); Kabat E. A. et al., National Institutes of Health, Bethesda, Md. (1991)). The three CDRs are interposed between flanking stretches known as framework regions (FRs), which are more highly conserved than the CDRs and form a scaffold to support the hypervariable loops. Each HCVR and LCVR comprises four FRs, and the CDRs and FRs are arranged from amino terminus to carboxy terminus in the order: FR1, CDR1, FR2, CDR2, FR3, CDR3, FR4. The constant regions of the heavy and light chains are not involved in antigen binding, but exhibit various effector functions. Antibodies are assigned to classes based on the amino acid sequence of the constant region of their heavy chain. The five major classes or isotypes of antibodies are IgA, IgD, IgE, IgG, and IgM, which are characterized by the presence of α, δ, ε, γ, and μ heavy chains, respectively. Several of the major antibody classes are divided into subclasses such as IgG1 (γ1 heavy chain), IgG2 (γ2 heavy chain), IgG3 (γ3 heavy chain), IgG4 (γ4 heavy chain), IgA1 (α1 heavy chain), or IgA2 (α2 heavy chain).

The term "variable domain" with respect to an antibody as used herein refers to an antibody variable region or a fragment thereof comprising one or more CDRs. Although a variable domain may comprise an intact variable region (such as HCVR or LCVR), it is also possible to comprise less than an intact variable region yet still retain the capability of binding to an antigen or forming an antigen-binding site.

The term "antigen-binding moiety" as used herein refers to an antibody fragment formed from a portion of an antibody comprising one or more CDRs, or any other antibody fragment that binds to an antigen but does not comprise an intact native antibody structure. Examples of antigen-binding moiety include, without limitation, a variable domain, a variable region, a diabody, a Fab, a Fab', a F(ab')$_2$, an Fv fragment, a disulphide stabilized Fv fragment (dsFv), a (dsFv)$_2$, a bispecific dsFv (dsFv-dsFv'), a disulphide stabilized diabody (ds diabody), a multispecific antibody, a camelized single domain antibody, a nanobody, a domain antibody, and a bivalent domain antibody. An antigen-binding moiety is capable of binding to the same antigen to which the parent antibody binds. In certain embodiments, an antigen-binding moiety may comprise one or more CDRs from a particular human antibody grafted to a framework region from one or more different human antibodies. For more and detailed formats of antigen-binding moiety are described in Spiess et al, 2015 (Supra), and Brinkman et al., mAbs, 9(2), pp. 182-212 (2017), which are incorporated herein by their entirety.

"Fab" with regard to an antibody refers to that portion of the antibody consisting of a single light chain (both variable and constant regions) associating to the variable region and first constant region of a single heavy chain by a disulphide bond. In certain embodiments, the constant regions of both the light chain and heavy chain are replaced with TCR constant regions.

"Fab'" refers to a Fab fragment that includes a portion of the hinge region.

"F(ab')$_2$" refers to a dimer of Fab'.

"Bibody" refers to a fusion protein formed by fusing a scFv to the C-terminus of either the light chain (Fab-L-scFv) or Fd (Fab-H-scFv).

"Tribody" refers to a fusion protein formed by fusing a scFv to both light chain and heavy chain (Fab-(scFv)$_2$).

A "WuXiBody" is a bispecific antibody comprising soluble chimeric protein with variable domains of an antibody and the constant domains of TCR, wherein the subunits (such as alpha and beta domains) of TCR constant domains are linked by engineered disulfide bond.

A "fragment difficult (Fd)" with regard to an antibody refers to the amino-terminal half of the heavy chain fragment that can be combined with the light chain to form Fab.

"Fc" with regard to an antibody refers to that portion of the antibody consisting of the second (CH2) and third (CH3) constant regions of a first heavy chain bound to the second and third constant regions of a second heavy chain via disulphide bonding. The Fc portion of the antibody is responsible for various effector functions such as ADCC, and CDC, but does not function in antigen binding.

"Hinge region" in terms of an antibody includes the portion of a heavy chain molecule that joins the CH1 domain to the CH2 domain. This hinge region comprises approximately 25 amino acid residues and is flexible, thus allowing the two N-terminus antigen binding regions to move independently.

"CH2 domain" as used herein refers to includes the portion of a heavy chain molecule that extends, e.g., from about amino acid 244 to amino acid 360 of an IgG antibody using conventional numbering schemes (amino acids 244 to 360, Kabat numbering system; and amino acids 231-340, EU numbering system; see Kabat, E., et al., U.S. Department of Health and Human Services, (1983)).

The "CH3 domain" extends from the CH2 domain to the C-terminus of the IgG molecule and comprises approximately 108 amino acids. Certain immunoglobulin classes, e.g., IgM, further include a CH4 region.

"Fv" with regard to an antibody refers to the smallest fragment of the antibody to bear the complete antigen binding site. An Fv fragment consists of the variable domain of a single light chain bound to the variable domain of a single heavy chain. A number of Fv designs have been provided, including dsFvs, in which the association between the two domains is enhanced by an introduced disulphide bond; and scFvs can be formed using a peptide linker to bind the two domains together as a single polypeptide. Fvs constructs containing a variable domain of a heavy or light immunoglobulin chain associated to the variable and constant domain of the corresponding immunoglobulin heavy or light chain have also been produced. Fvs have also been multimerised to form diabodies and triabodies (Maynard et al., Annu Rev Biomed Eng 2 339-376 (2000)).

"ScFab" refers to a fusion polypeptide with a Fd linked to a light chain via a polypeptide linker, resulting in the formation of a single chain Fab fragment (scFab).

"TriFabs" refers to a trivalent, bispecific fusion protein composed of three units with Fab-functionalities. TriFabs harbor two regular Fabs fused to an asymmetric Fab-like moiety.

"Fab-Fab" refers to a fusion protein formed by fusing the Fd chain of a first Fab arm to the N-terminus of the Fd chain of a second Fab arm.

"Fab-Fv" refers to a fusion protein formed by fusing a HCVR to the C-terminus of a Fd chain and a LCVR to the C-terminus of a light chain. A "Fab-dsFv" molecule can be formed by introducing an interdomain disulphide bond between the HCVR domain and the LCVR domain.

"MAb-Fv" or "IgG-Fv" refers to a fusion protein formed by fusion of HCVR domain to the C-terminus of one Fc chain and the LCVR domain either expressed separately or fused to the C-terminus of the other resulted in a bispecific, trivalent IgG-Fv (mAb-Fv) fusion protein, with the Fv stabilized by an interdomain disulphide bond.

"ScFab-Fc-scFv$_2$" and "ScFab-Fc-scFv" refer to a fusion protein formed by fusion of a single-chain Fab with Fc and disulphide-stabilized Fv domains.

"Appended IgG" refers to a fusion protein with a Fab arm fused to an IgG to form the format of bispecific (Fab)$_2$-Fc. It can form a "IgG-Fab" or a "Fab-IgG", with a Fab fused to the C-terminus or N-terminus of an IgG molecule with or without a connector. In certain embodiments, the appended IgG can be further modified to a format of IgG-Fab$_4$ (see, Brinkman et al., 2017, Supra).

"DVD-Ig" refers to a dual-variable-domain antibody that is formed by fusion of an additional HCVR domain and LCVR domain of a second specificity to an IgG heavy chain and light chain. "CODV-Ig" refers to a related format where the two HCVR and two LCVR domains are linked in a way that allows crossover pairing of the variable HCVR-LCVR domains, which are arranged either (from N- to C-terminus) in the order HCVRA-HCVRB and LCVRB-LCVRA, or in the order HCVRB-HCVRA and LCVRA-LCVRB.

A "CrossMab" refers to a technology of pairing of unmodified light chain with the corresponding unmodified heavy chain and pairing of the modified light chain with the corresponding modified heavy chain, thus resulting an antibody with reduced mispairing in the light chain.

A "BiTE" is a bispecific T-cell engager molecule, comprising a first scFv with a first antigen specificity in the LCVR-HCVR orientation linked to a second scFv with a second specificity in the HCVR-LCVR orientation.

"Percent (%) sequence identity" with respect to amino acid sequence (or nucleic acid sequence) is defined as the percentage of amino acid (or nucleic acid) residues in a candidate sequence that are identical to the amino acid (or nucleic acid) residues in a reference sequence, after aligning the sequences and, if necessary, introducing gaps, to achieve the maximum number of identical amino acids (or nucleic acids). Conservative substitution of the amino acid residues may or may not be considered as identical residues. Alignment for purposes of determining percent amino acid (or nucleic acid) sequence identity can be achieved, for example, using publicly available tools such as BLASTN, BLASTp (available on the website of U.S. National Center for Biotechnology Information (NCBI), see also, Altschul S. F. et al., J. Mol. Biol., 215:403-410 (1990); Stephen F. et al., Nucleic Acids Res., 25:3389-3402 (1997)), ClustalW2 (available on the website of European Bioinformatics Institute, see also, Higgins D. G. et al., Methods in Enzymology, 266:383-402 (1996); Larkin M. A. et al., Bioinformatics (Oxford, England), 23(21): 2947-8 (2007)), and ALIGN or Megalign (DNASTAR) software. Those skilled in the art may use the default parameters provided by the tool, or may customize the parameters as appropriate for the alignment, such as for example, by selecting a suitable algorithm.

An "antigen" or "Ag" as used herein refers to a compound, composition, peptide, polypeptide, protein or substance that can stimulate the production of antibodies or a T cell response in cell culture or in an animal, including compositions (such as one that includes a cancer-specific protein) that are added to a cell culture (such as a hybridoma), or injected or absorbed into an animal. An antigen reacts with the products of specific humoral or cellular immunity (such as an antibody), including those induced by heterologous antigens.

An "epitope" or "antigenic determinant" refers to the region of an antigen to which a binding agent (such as an antibody) binds. Epitopes can be formed both from contiguous amino acids (also called linear or sequential epitope) or noncontiguous amino acids juxtaposed by tertiary folding of a protein (also called configurational or conformational epitope). Epitopes formed from contiguous amino acids are typically arranged linearly along the primary amino acid residues on the protein and the small segments of the contiguous amino acids can be digested from an antigen binding with major histocompatibility complex (MHC) molecules or retained on exposure to denaturing solvents whereas epitopes formed by tertiary folding are typically lost on treatment with denaturing solvents. An epitope typically includes at least 3, and more usually, at least 5, about 7, or about 8-10 amino acids in a unique spatial conformation.

The term "specific binding" or "specifically binds" as used herein refers to a non-random binding reaction between two molecules, such as for example between an antibody and an antigen. In certain embodiments, the polypeptide complex and the bispecific polypeptide complex provided herein specifically bind an antigen with a binding affinity ($K_D$) of $\leq 10^{-6}$ M (e.g., $\leq 5 \times 10^{-7}$ M, $\leq 2 \times 10^{-7}$ M, $\leq 10^{-7}$ M, $\leq 5 \times 10^{-8}$ M, $\leq 2 \times 10^{-8}$ M, $\leq 10^{-8}$ M, $\leq 5 \times 10^{-9}$ M, $\leq 2 \times 10^{-9}$ M, $\leq 10^{-9}$ M, or $\leq 10^{-10}$ M). $K_D$ as used herein refers to the ratio of the dissociation rate to the association rate ($k_{off}/k_{on}$), may be determined using surface plasmon resonance methods for example using instrument such as Biacore.

The term "operably link" or "operably linked" refers to a juxtaposition, with or without a spacer or linker, of two or more biological sequences of interest in such a way that they are in a relationship permitting them to function in an intended manner. When used with respect to polypeptides, it is intended to mean that the polypeptide sequences are linked in such a way that permits the linked product to have the intended biological function. For example, an antibody variable region may be operably linked to a constant region so as to provide for a stable product with antigen-binding activity. The term may also be used with respect to polynucleotides. For one instance, when a polynucleotide encoding a polypeptide is operably linked to a regulatory sequence (e.g., promoter, enhancer, silencer sequence, etc.), it is intended to mean that the polynucleotide sequences are linked in such a way that permits regulated expression of the polypeptide from the polynucleotide.

The term "fusion" or "fused" when used with respect to amino acid sequences (e.g. peptide, polypeptide or protein) refers to combination of two or more amino acid sequences, for example by chemical bonding or recombinant means, into a single amino acid sequence which does not exist naturally. A fusion amino acid sequence may be produced by genetic recombination of two encoding polynucleotide sequences, and can be expressed by a method of introducing a construct containing the recombinant polynucleotides into a host cell.

The term "spacer" as used herein refers to an artificial amino acid sequence having 1, 2, 3, 4 or 5 amino acid residues, or a length of between 5 and 15, 20, 30, 50 or more amino acid residues, joined by peptide bonds and are used to link one or more polypeptides. A spacer may or may not have a secondary structure. Spacer sequences are known in the art, see, for example, Holliger et al., Proc. Natl. Acad. Sci. USA 90:6444-6448 (1993); Poljak et al. Structure 2:1121-1123 (1994). Any suitable spacers known in the art can be used. For example, a useful spacer in the present disclosure may be rich in glycine and proline residues. Examples include spacers having a single or repeated sequences composed of threonine/serine and glycine, such as TGGGG (SEQ ID NO: 266), GGGGS (SEQ ID NO: 267) or SGGGG (SEQ ID NO: 268) or its tandem repeats (e.g. 2, 3, 4, or more repeats). Alternatively, a spacer may be a long peptide chain containing one or more sequential or tandem repeats of the amino acid sequence of GAPGGGG-GAAAAAGGGGG (SEQ ID NO: 269). In certain embodiment, the spacer comprises 1, 2, 3, 4 or more sequential or tandem repeats of SEQ ID NO: 269.

The term "antigenic specificity" refers to a particular antigen or an epitope thereof that is selectively recognized by an antigen-binding molecule.

The term "substitution" with regard to amino acid residue as used herein refers to naturally occurring or induced replacement of one or more amino acids with another in a peptide, polypeptide or protein. Substitution in a polypeptide may result in diminishment, enhancement, or elimination of the polypeptide's function.

Substitution can also be "conservative substitution" with reference to amino acid sequence refers to replacing an amino acid residue with a different amino acid residue having a side chain with similar physiochemical properties or substitution of those amino acids that are not critical to the activity of the polypeptide. For example, conservative substitutions can be made among amino acid residues with nonpolar side chains (e.g., Met, Ala, Val, Leu, and Ile, Pro, Phe, Trp), among residues with uncharged polar side chains (e.g., Cys, Ser, Thr, Asn, Gly and Gln), among residues with acidic side chains (e.g., Asp, Glu), among amino acids with basic side chains (e.g., His, Lys, and Arg), among amino acids with beta-branched side chains (e.g., Thr, Val and Ile), among amino acids with sulfur-containing side chains (e.g., Cys and Met), or among residues with aromatic side chains (e.g., Trp, Tyr, His and Phe). In certain embodiments, substitutions, deletions or additions can also be considered as "conservative substitution." The number of amino acids that are inserted or deleted can be in the range of about 1 to 5. Conservative substitution usually does not cause significant change in the protein conformational structure, and therefore could retain the biological activity of a protein.

The term "mutation" or "mutated" with regard to amino acid residue as used herein refers to substitution, insertion, or addition of an amino acid residue.

As used herein, a "homologue sequence" and "homologous sequence" are used interchangeably and refer to polynucleotide sequences (or its complementary strand) or amino acid sequences that have sequences identity of at least 80% (e.g. at least 85%, 88%, 90%, 91%, 92%, 93%, 94%, 95%, 96%, 97%, 98%, 99%) to another sequences when optionally aligned.

"T cell" as used herein refers to a type of lymphocyte that plays a critical role in the cell-mediated immunity, including helper T cells (e.g. $CD4^+$ T cells, T helper 1 type T cells, T helper 2 type T cells, T helper 3 type T cells, T helper 17 type T cells), cytotoxic T cells (e.g. $CD8^+$ T cells), memory T cells (e.g. central memory T cells (TCM cells), effector memory T cells (TEM cells and TEMRA cells) and resident memory T cells (TRM) that are either CD8+ or CD4+), natural killer T (NKT) cells and inhibitory T cells.

A native "T cell receptor" or a native "TCR" is a heterodimeric T cell surface protein which is associated with invariant CD3 chains to form a complex capable of mediating signal transduction. TCR belongs to the immunoglobulin superfamily, and is similar to a half antibody with a single heavy chain and a single light chain. Native TCR has an extracellular portion, a transmembrane portion and an intracellular portion. The extracellular domain of a TCR has a membrane-proximal constant region and a membrane-distal variable region.

The term "subject" or "individual" or "animal" or "patient" as used herein refers to human or non-human animal, including a mammal or a primate, in need of diagnosis, prognosis, amelioration, prevention and/or treatment of a disease or disorder. Mammalian subjects include humans, domestic animals, farm animals, and zoo, sports, or pet animals such as dogs, cats, guinea pigs, rabbits, rats, mice, horses, swine, cows, bears, and so on.

A. Polypeptide Complex

Provided herein are novel polypeptide complexes that comprise an antibody heavy chain variable domain operably linked to a first T cell receptor (TCR) constant region, and an antibody light chain variable domain operably linked to a second TCR constant region, wherein the first TCR constant region and the second TCR constant region are associated via at least one non-native interchain bond. The polypeptide complex comprises at least two polypeptide chains, each of which comprises a variable domain derived from an antibody and a constant region derived from a TCR. The two polypeptide chains of the polypeptide complexes comprise a pair of heavy chain variable domain and a light chain variable domain, which are operably linked to a pair of TCR constant regions respectively. Examples of pairs of TCR constant regions include, for example, alpha/beta, pre-alpha/beta, and gamma/delta TCR constant regions. The TCR constant regions in the polypeptide complexes provided herein can be in full length or in a fragment, and can be engineered, as long as the pair of TCR constant regions are capable of associating with each other to form a dimer.

It is surprisingly found that the polypeptide complexes provided herein with at least one non-native interchain bond (in particular a non-native disulphlide bond) can be recombinantly expressed and assembled into the desired conformation, which stabilizes the TCR constant region dimer while providing for good antigen-binding activity of the antibody variable regions. Moreover, the polypeptide complexes are found to well tolerate routine antibody engineering, for example, modification of glycosylation sites, and removal of some natural sequences. Furthermore, the polypeptide complexes provided herein can be incorporated into a bispecific format which can be readily expressed and assembled with minimal or substantially no mispairing of the antigen-binding sequences due to the presence of the TCR constant regions in the polypeptide complexes. Additional advantages of the polypeptide complexes and constructs provided herein will become more evident in the following disclosure below.

In one aspect, the present disclosure provides polypeptide complexes, comprising a first polypeptide comprising, from N-terminus to C-terminus, a first heavy chain variable domain (VH) of a first antibody operably linked to a first T cell receptor (TCR) constant region (C1), and a second polypeptide comprising, from N-terminus to C-terminus, a first light chain variable domain (VL) of the first antibody operably linked to a second TCR constant region (C2), wherein: C1 and C2 are capable of forming a dimer comprising at least one non-native interchain bond between C1 and C2, and the non-native interchain bond is capable of stabilizing the dimer, and the first antibody has a first antigenic specificity.

i. TCR Constant Region

The polypeptide complexes provided herein comprise constant regions derived from a TCR.

Native TCR consists of two polypeptide chains, and has in general two types: one consists of alpha and beta chains (i.e. alpha/beta TCR), and the other consists of gamma and delta chains (i.e. gamma/delta TCR). These two types are structurally similar but have distinct locations and functions. About 95% human T cells have alpha/beta TCRs, whereas the rest 5% have gamma/delta TCRs. A precursor of alpha chain is also found and named as pre-alpha chain. Each of the two TCR polypeptide chains comprises an immunoglobulin domain and a membrane proximal region. The immunoglobulin region comprises a variable region and a constant region, and is characterized by the presence of an immunoglobulin-type fold. Each TCR polypeptide chain has a cysteine residue (e.g. at C terminal of the constant domain or at N terminal of the membrane proximal region) which together can form a disulphide bond that tethers the two TCR chains together.

FIGS. 18A-18E set forth the amino acid sequences of native TCR constant regions of TCR alpha, pre-alpha, beta, gamma and delta chains. For clarity and consistency, each of the amino acid residues in these sequences are numbered in FIGS. 19A-19E, and such numbering is used throughout the present disclosure to refer to a particular amino acid residue on a particular TCR constant region.

Human TCR alpha chain constant region is known as TRAC, with the NCBI accession number of P01848, or an amino acid sequence of SEQ ID NO: 254.

Human TCR beta chain constant region has two different variants, known as TRBC1 and TRBC2 (IMGT nomenclature), with corresponding sequences set forth in SEQ ID NO: 256 and SEQ ID NO: 257, respectively (see also Toyonaga B, et al., PNAs, Vol. 82, pp. 8624-8628, Immunology (1985)). These two beta constant domains are different in the $4^{th}$, $5^{th}$ and $37^{th}$ amino acid residues of exon 1. Specifically, TRBC1 has 4N, 5K and 37F in exon 1, and TRBC2 has 4K, 5N and 37Y in exon 1.

Specifically, the native TCR beta chain contains a native cysteine residue at position 74 (see FIG. 19B), which is unpaired and therefore does not form a disulphide bond in a native alpha/beta TCR. In certain embodiments, in the polypeptide complexes provided herein, this native cysteine residue is absent or mutated to another residue. This may be useful to avoid incorrect intrachain or interchain pairing. In certain embodiments, the native cysteine residue is substituted for another residue, for example serine or alanine. In certain embodiments, the substitution in certain embodiments can improve the TCR refolding efficiencies in vitro.

Human TCR gamma chain constant regions have two variants, known as TRGC1 and TRGC2 (see Lefranc et al., Eur. J. Immunol. 19:989-994 (1989)), with the NCBI accession number of A26659 and P03986, respectively, or amino acid sequences of SEQ ID NO: 263 and SEQ ID NO: 265, respectively.

Human TCR delta chain constant region is known as TRDC, with the NCBI accession number of A35591, or an amino acid sequence of SEQ ID NO: 261.

The constant region of TCR in the polypeptide complexes provided herein may also be derived from pre-T-cell antigen receptor (pre-TCR). Pre-TCR is expressed by immature thymocytes, which has a pivotal role in early T-cell development. Pre-TCR has a regular beta chain, but a special pre-alpha chain with only constant region available, with sequence and structure distinct from those of regular alpha chain (see Harald von Boehmer, Nat Rev Immunol, July; 5(7):571-7 (2005)). The sequence of human pre-alpha chain constant region (PTCRA) has the NCBI accession number of AAF89556.1, or an amino acid sequence of SEQ ID NO: 259.

In the present disclosure, the first and the second TCR constant regions of the polypeptide complexes provided herein are capable of forming a dimer comprising, between the TCR constant regions, at least one non-native interchain bond that is capable of stabilizing the dimer.

The term "dimer" as used herein refers to an associated structure formed by two molecules, such as polypeptides or proteins, via covalent or non-covalent interactions. A homodimer or homodimerization is formed by two identical molecules, and a heterodimer or heterodimerization is formed by two different molecules. The dimer formed by the first and the second TCR constant regions is a heterodimer.

An interchain bond is formed between one amino acid residue on one TCR constant region and another amino acid residue on the other TCR constant region. In certain embodiments, the non-native interchain bond can be any bond or interaction that is capable of associating two TCR constant regions into a dimer. Examples of suitable non-native interchain bond include, a disulphide bond, a hydrogen bond, electrostatic interaction, a salt bridge, or hydrophobic-hydrophilic interaction, a knobs-into-holes or the combination thereof.

A "disulphide bond" refers to a covalent bond with the structure R—S—S—R'. The amino acid cysteine comprises a thiol group that can form a disulphide bond with a second thiol group, for example from another cysteine residue. The disulphide bond can be formed between the thiol groups of two cysteine residues residing respectively on the two polypeptide chains, thereby forming an interchain bridge or interchain bond.

Electrostatic interaction is non-covalent interaction and is important in protein folding, stability, flexibility and function, including ionic interactions, hydrogen bonding and halogen bonding. Electrostatic interactions can be formed in a polypeptide, for example, between Lys and Asp, between Lys and Glu, between Glu and Arg, or between Glu, Trp on the first chain and Arg, Val or Thr on the second chain.

A salt bridge is close-range electrostatic interactions that mainly arises from the anionic carboxylate of either Asp or Glu and the cationic ammonium from Lys or the guanidinium of Arg, which are spatially proximal pairs of oppositely charged residues in native protein structures. Charged and polar residues in largely hydrophobic interfaces may act as hot spots for binding. Among others, residues with ionizable side chains such as His, Tyr, and Ser can also participate the formation of a salt bridge.

A hydrophobic interaction can be formed between one or more Val, Tyr and Ala on the first chain and one or more Val, Leu, and Trp on the second chain, or His and Ala on the first chain and Thr and Phe on the second chain (see Brinkmann, et al., 2017, Supra).

A hydrogen bond is formed by electrostatic attraction between two polar groups when a hydrogen atom covalently bound to a highly electronegative atom such as nitrogen, oxygen, or fluorine. A hydrogen bond can be formed in a polypeptide between the backbone oxygens (e.g. chalcogen groups) and amide hydrogens (nitrogen group) of two residues, respectively, such as a nitrogen group in Asn and an oxygen group in His, or an oxygen group in Asn and a nitrogen group in Lys. A hydrogen bond is stronger than a Van der Waals interaction, but weaker than covalent or ionic bonds, and is critical in maintaining the secondary structure and tertiary structure. For example, an alpha helix is formed when the spacing of amino acid residues occurs regularly between positions i and i+4, and a beta sheet is a stretch of peptide chain 3-10 amino acids long formed when two peptides joined by at least two or three backbone hydrogen bonds, forming a twisted, pleated sheet.

"Knobs-into-holes" as used herein, refers to an interaction between two polypeptides, where one polypeptide has a protuberance (i.e. "knob") due to presence of an amino acid residue having a bulky side chain (e.g. tyrosine or tryptophan), and the other polypeptide has a cavity (i.e. "hole") where a small side chain amino acid residue resides (e.g. alanine or threonine), and the protuberance is positionable in the cavity so as to promote interaction of the two polypeptides to form a heterodimer or a complex. Methods of generating polypeptides with knobs-into-holes are known in the art, e.g., as described in U.S. Pat. No. 5,731,168.

In certain embodiments, the TCR constant region dimer comprises 1, 2, 3, 4, 5, 6, 7, 8, 9 or 10 non-native interchain bonds. Optionally, at least one of the 1, 2, 3, 4, 5, 6, 7, 8, 9 or 10 non-native interchain bonds are disulphide bonds, hydrogen bonds, electrostatic interaction, salt bridge, or hydrophobic-hydrophilic interaction, or any combination thereof.

A "non-native" interchain bond as used herein refers to an interchain bond which is not found in a native association of the native counterpart TCR constant regions. For example, a non-native interchain bond can be formed between a mutated amino acid residue and a native amino acid residue, each residing on a respective TCR constant region; or alternatively between two mutated amino acid residues residing respectively on the TCR constant regions. In certain embodiments, the at least one non-native interchain bond is formed between a first mutated residue comprised in the first TCR constant region and a second mutated residue comprised in the second TCR constant region of the polypeptide complex.

A "mutated" amino acid residue refers to one which is substituted, inserted or added and is different from its native counterpart residue in a corresponding native TCR constant region. For example, if an amino acid residue at a particular position in the wild-type TCR constant region is referred to as the "native" residue, then its mutated counterpart is any residue that is different from the native residue but resides at the same position on the TCR constant region. A mutated residue can be a different residue which substitutes the native residue at the same position, or which is inserted before the native residue and therefore takes up its original position.

In certain embodiments, the mutated residue may be a naturally-occurring amino acid residue. In certain embodiments, at least one of the first and the second non-native amino acid residues is a mutated cysteine residue. In certain embodiments, one or more of the non-native interchain bond is a disulphide bond. In certain embodiments, the non-native disulphide bond can be formed between two mutated cysteine residues comprised in the first and the second TCR constant regions respectively.

In certain embodiments, at least one of the first and the second mutated residues is a non-naturally-occurring amino acid residue. A non-naturally-occurring amino acid residue refers to an amino acid residue that is not naturally found in human proteins but can be expressed via a nucleic acid codon that can be incorporated into the encoding polynucleotide. For example, non-naturally occurring amino acid such as $_L$-3,4-dihydroxyphenylalanine ($_L$-DOPA) can react and crosslink to natural amino acids such as cysteine, histidine and lysine by periodate induced oxidation. It has been shown that by incorporating $_L$-DOPA into an antibody, the non-natural amino acid was able to effectively crosslink to residues on the antigen, resulting in a covalently bonded antibody-antigen complex (Xu, J. et al., 2014, Structure-based non-canonical amino acid design to covalently crosslink an antibody-antigen complex. Journal of Structural Biology, 185(2), pp. 215-222.). It is contemplated herein that the mutated amino acid residue in the first and/or the second TCR constant regions may comprise a non-naturally occurring amino acid residue such as $_L$-DOPA which can crosslink with a natural amino acid residue (or alternatively a non-naturally occurring amino acid residue) to form a non-native interchain covalent bond.

In certain embodiments, at least one non-native disulphide bonds is formed between a mutated cysteine residue and a native cysteine residue. In certain embodiments, the non-native disulphide bonds are formed between two mutated cysteine residues. In certain embodiments, at least one of the cysteine residues forming the non-native disulphide bond is a mutated cysteine residue. In certain embodiments, both of the cysteine residues forming the non-native disulphide bond are mutated cysteine residues on the first and the second TCR constant regions respectively.

In certain embodiments, the first and/or the second TCR constant regions can be engineered to comprise one or more mutated amino acid residues that is responsible for forming the non-native interchain bond. To introduce such a mutated residue to the TCR constant region, an encoding sequence of a TCR region can be manipulated to for example, substitute a codon encoding a native residue for the codon encoding the mutated residue, or to insert a codon encoding the mutated residue before the codon of the native residue. One or more desired mutated amino acid residues can be introduced to the TCR constant region, for example, one or more amino acid residue (e.g. cysteine residue) that is capable of forming a disulphide bond, that may lead to electrostatic interactions between the two TCR constant regions, that may increase the flexibility of the TCR constant regions, that position at least one of the covalent bond forming amino acids away from the TCR constant domain, such as a hydrogen bond, that may contribute to formation of a salt bridge; hydrophobic amino acid residues capable of leading to hydrophobic interactions; and hydrophilic amino acid residues capable of leading to hydrophilic interactions, and so on.

In certain embodiments, the first and/or the second TCR constant regions can be engineered to comprise one or more mutated cysteine residues. For example, a non-cysteine residue can be replaced to a cysteine residue, or a cysteine residue can be inserted in between two originally adjacent native non-cysteine residues. The positions of replacement can be determined such that, after replacement to cysteine residues, a non-native interchain disulphide bond could be formed between the two TCR constant regions. To this end, multiple factors can be considered, including, for example, the cysteine residues forming the disulphide bond may be in sufficiently close proximity, may have suitable alpha-beta bond orientation, the thiol groups of the cysteine residues may be oriented to face each other, the residue to be replaced may have a side chain with relatively similar chemical property to that of cysteine, and/or the replacement would not substantially perturb the tertiary structure of the TCR constant region or the polypeptide complex itself.

A skilled person in the art may determine the distance and angle between two amino acid residues to be replaced using suitable methods known in the art, for example without limitation, distance maps by photodetection, computer modelling, NMR spectroscopy or X-ray crystallography. In an illustrative example, for an interested polypeptide (such as a TCR constant region), its protein crystal structure can be obtained from public databases such as PDB database, or alternatively be elucidated using methods such as X-ray crystallography. Suitable computer software can be used to determine distances and angles between amino acid residues based on the protein crystal structure data. In certain embodiments, in the polypeptide complex provided herein, a disulphide bond can be formed between mutated cysteine residues having respective beta carbons sufficiently close, for example, a distance less than 8 angstroms, 7 angstroms, 6 angstroms, 5 angstroms, 4 angstroms, 3 angstroms, 2 angstroms, 1 angstrom, or less when the complex is correctly folded.

Further suitable positions for engineering to the first and/or the second TCR constant regions can be taken from the crystal structure data published on the complex between TCR alpha and beta (Boulter, J. M. et al., Protein engineering, 16(9), pp. 707-711 (2003)), or gamma and delta (Allison, T. J. et al., Nature, 411(6839), pp. 820-824 (2001); Uldrich, A. P. et al., Nature Immunology, 14(11), pp. 1137-1145 (2013)). Once the residue to be replaced are determined, a skilled person can readily identify the interested codon to be mutated (for example through sequence alignment using existing software such as ClustalW (European Bioinformatics Institute website (www.ebi.ac.uk/index.html)), and then mutate it to cysteine codon by methods known in the art such as PCR mutagenesis.

Formation of the interchain disulphide bond can be determined by suitable methods known in the art. For example, the expressed protein product can be subject to reduced and non-reduced SDS-PAGE respectively, followed by comparison of the resulting bands to identify potential difference which indicates presence of interchain disulphide bond.

The non-native interchain bond is capable of stabilizing the polypeptide complex. Such effects in stablization can be embodied in various ways. For example, the presence of the mutated amino acid residue or the non-native interchain bond can enable the polypeptide complex to stably express, and/or to express in a high level, and/or to associate into a stable complex having the desired biological activity (e.g. antigen binding activity), and/or to express and assemble into a high level of desired stable complex having the desired biological activity. The capability of the interchain bond to stabilize the first and the second TCR constant regions can be assessed using proper methods known in the art, such as the molecular weight displayed on SDS-PAGE, or thermostability measured by differential scanning calorimetry (DSC) or differential scanning fluorimetry (DSF). In an illustrative example, formation of a stable polypeptide complex provided herein can be confirmed by SDS-PAGE, if a product shows a molecular weight comparable to the combined molecular weight of the first and the second polypeptides. In certain embodiments, the polypeptide complex provided herein is stable in that its thermal stability is no less than 50%, 60%, 70%, 80%, or 90% of that of a natural Fab. In certain embodiments, the polypeptide complex provided herein is stable in that its thermal stability is comparable to that of a natural Fab.

Without wishing to be bound by any theory, it is believed that the non-native interchain bond (such as a disulphide bond) formed between the first and the second TCR constant regions in the polypeptide complexes are capable of stabilizing the heterodimer of TCR constant regions, thereby enhancing the level of correct folding, the structural stability and/or the expression level of the heterodimer and of the polypeptide complexes. Unlike native TCR anchored on the membrane of T cell surface, heterodimers of native TCR extracellular domains are found to be much less stable, despite of its similarity to antibody Fab in 3D structure. As a matter of fact, the instability of native TCR in soluble condition used to be a significant obstacle that prevents elucidation of its crystal structure (see Wang, *Protein Cell*, 5(9), pp. 649-652 (2014)). By introducing a pair of Cysteine (Cys) mutations in TCR constant regions and thereby enabling formation of interchain non-native disulphide bond, the polypeptide complexes can be stably expressed while in the meantime the antigen-binding capabilities of the antibody variable region are retained.

The TCR constant region comprising a mutated residue is also referred to herein as an "engineered" TCR constant region. In certain embodiments, the first TCR constant region (C1) of the polypeptide complex comprises an engineered TCR Alpha chain (CAlpha), and the second TCR constant region (C2) comprises an engineered TCR Beta chain (CBeta). In certain embodiments, C1 comprises an engineered CBeta, and C2 comprises an engineered CAlpha. In certain embodiments, C1 comprises an engineered TCR Pre-Alpha chain (CPre-Alpha), and C2 comprises an engineered CBeta. In certain embodiments, C1 comprises an engineered CBeta, and C2 comprises an engineered CPre-Alpha. In certain embodiments, C1 comprises an engineered TCR Gamma chain (CGamma), and C2 comprises an engineered TCR Delta chain (CDelta). In certain embodiments, C1 comprises an engineered CDelta, and C2 comprises an engineered CGamma.

In certain embodiments, the engineered TCR constant region comprises one or more mutated cysteine residue. In certain embodiments, the one or more mutated residue is comprised within a contact interface of the first and/or the second engineered TCR constant regions.

The term "contact interface" as used herein refers to the particular region(s) on the polypeptides where the polypeptides interact/associate with each other. A contact interface comprises one or more amino acid residues that are capable of interacting with the corresponding amino acid residue(s) that comes into contact or association when interaction occurs. The amino acid residues in a contact interface may or may not be in a consecutive sequence. For example, when the interface is three-dimensional, the amino acid residues within the interface may be separated at different positions on the linear sequence.

In certain embodiments, the engineered CBeta comprises a mutated cysteine residue within a contact interface selected from the group consisting of: amino acid residues 9-35, 52-66, 71-86, and 122-127. In certain embodiments, the engineered CAlpha comprises a mutated cysteine residue within a contact interface selected from a group consisting of: amino acid residues 6-29, 37-67, and 86-95. Unless specified, the numbering of amino acid residues in the TCR constant region in the present disclosure is as set forth in FIGS. 19A-19E.

In certain embodiments, one or more disulphide bonds can be formed between the engineered CAlpha and the engineered CBeta. The mutated cysteine residue in CBeta can be a substitution selected from the group consisting of: S56C, S16C, F13C, V12C, E14C, F13C, L62C, D58C, S76C, and R78C, and/or the mutated cysteine residues in CAlpha can be a substitution selected from the group consisting of: T49C, Y11C, L13C, S16C, V23C, Y44C, T46C, L51C, and S62C. In certain embodiments, the pair of mutated cysteine residues can be a pair of substitutions selected from the group consisting of: S16C in CBeta and Y11C in CAlpha, F13C in CBeta and L13C in CAlpha, S16C in CBeta and L13C in CAlpha, V12C in CBeta and S16C in CAlpha, E14C in CBeta and S16C in CAlpha, F13C in CBeta and V23C in CAlpha, L62C in CBeta and Y44C in CAlpha, D58C in CBeta and T46C in CAlpha, S76C in CBeta and T46C in CAlpha, S56C in CBeta and T49C in CAlpha, S56C in CBeta and L51C in CAlpha, S56C in CBeta and S62C in CAlpha, and R78C in CBeta and S62C in CAlpha, and wherein the pair of cysteine residues are capable of forming a non-native interchain disulphide bond.

As used herein throughout the application, "XnY" with respect to a TCR constant region is intended to mean that the n$^{th}$ amino acid residue X on the TCR constant region (based on the numbering in FIGS. 19A-19E as provided herein) is replaced by amino acid residue Y, where X and Y are respectively the one-letter abbreviation of a particular amino acid residue. It should be noted that the number n is solely based on the numbering provided in FIGS. 19A-19E, and it could appear different from its actual position. To illustrate, the sequence of CBeta(S56C)(N69Q) shown in SEQ ID NO: 34 is used as an example. While the substitution of S to C occurs at the 48$^{th}$ residue in SEQ ID NO:34, the very residue is designated as the 56$^{th}$ residue based on the numbering system in FIGS. 19A-19E, and therefore that substitution of S to C is designated as S56C, but not S48C. Similarly, the substitution of N to Q is also designated as N69Q based on the numbering system in FIGS. 19A-19E. This designation rule of amino acid residue substitution applies to all TCR constant region in the present disclosure, unless otherwise specified. Similarly, "XnY" when used with respect to an Fc region, is intended to mean that the n$^{th}$ amino acid residue X on the Fc constant region (based on the numbering in FIGS. 20A-20D as provided herein) is replaced by amino acid residue Y.

In certain embodiments, the engineered CBeta comprises or is any one of SEQ ID NOs: 33-41, and the engineered CAlpha comprises or is any one of SEQ ID NOs: 43-48.

In certain embodiments, one or more non-native disulphide bonds can be formed within the contact interfaces between CPre-Alpha and CBeta. In certain embodiments, the contact interface on CPre-Alpha is selected from substitutions at position amino acid residues 7-19, 26-34, 56-75 and 103-106. In certain embodiments, the contact interface on CBeta is selected from substitutions at position amino acid residues 9-35, 52-66, 71-86 and 122-127.

In certain embodiments, one or more disulphide bonds can be formed between the engineered Pre-TCR alpha constant region (CPre-Alpha) and beta chain constant region (CBeta). The mutated cysteine residues in CBeta can be a substitution selected from the group consisting of: S16C, A18C, E19C, F13C, A11C, S56C, and S76C, and/or the mutated cysteine residues in CPre-Alpha can be a substitution selected from the group consisting of: S11C, A13C, I16C, S62C, T65C, and Y59. In certain embodiments, the pair of mutated cysteine residues can be a pair of substitutions selected from the group consisting of: S16C in CBeta and S11C in CPre-Alpha, A18C in CBeta and S11C in CPre-Alpha, E19C in CBeta and S11C in CPre-Alpha, F13C in CBeta and A13C in CPre-Alpha, S16C in CBeta and A13C in CPre-Alpha, A11C in CBeta and I16C in CPre-Alpha, S56C in CBeta and S62C in CPre-Alpha, S56C in CBeta and T65C in CPre-Alpha, and S76C in CBeta, and Y59C in CPre-Alpha, and wherein the pair of mutated cysteine residues are capable of forming a non-native interchain disulphide bond.

In certain embodiments, the engineered CBeta comprises or is any one of SEQ ID NOs: 33-41, and the engineered CPre-Alpha comprises or is any one of SEQ ID NOs: 82 and 83.

In certain embodiments, one or more non-native disulphide bonds can be formed within the contact interfaces between CGamma and CDelta. In certain embodiments, the contact interface on CGamma is selected from substitutions at position amino acid residues 11-35 and 55-76. In certain embodiments, the contact interface on CDelta is selected from substitutions at position amino acid residues 8-26, 43-64, and 84-88.

In certain embodiments, one or more disulphide bonds can be formed between the engineered CGamma and CDelta. The mutated cysteine residue in CGamma can be a substitution selected from the group consisting of: S17C, E20C, F14C, T12C, M62C, Q57C, and A19C, and/or the mutated cysteine residues in CDelta can be a substitution selected from the group consisting of: F12C, M14C, N16C, D46C, V50C, F87C, and E88C. In certain embodiments, the pair of mutated cysteine residues can be a pair of substitutions selected from the group consisting of: S17C in CGamma and F12C in CDelta, E20C in CGamma and F12C in CDelta, F14C in CGamma and M14C in CDelta, T12C in CGamma and N16C in CDelta, M62C in CGamma and D46C in CDelta, Q57C in CGamma and V50C in CDelta, A19C in CGamma and F87C in CDelta, and A19C in CGamma and E88C in CDelta, and wherein the introduced pair of cysteine residues are capable of forming an interchain disulphide bond.

In certain embodiments, the engineered CGamma comprises or is any one of SEQ ID NOs: 113 and 114, and the engineered CDelta comprises or is any one of SEQ ID NOs: 115 and 116.

In addition to the non-native amino acid residue, the engineered TCR constant region in certain embodiments may further comprise an additional modification to one or more native residues in the wild-type TCR constant region sequence. Examples of such additional modification include, such as modification to a native cysteine residue, modification to a native glycosylation site, and/or modification to a native loop.

Certain native TCR constant regions (such as CBeta) comprise a native cysteine residue which, in some embodiments of the present disclosure could be modified (e.g. removed), or alternatively could be kept in some other embodiments. In certain embodiments, a native disulphide bond on the alpha/beta heterodimeric TCR between the TRAC and TRBC1 or TRBC2 constant domain, i.e. between Cys4 of exon 2 of TRAC and Cys2 of exon 2 of TRBC1 or TRBC2, according to IMGT TCR nomenclature, may be present or absent.

In certain embodiments, at least one native cysteine residue is absent or present in the engineered CBeta. For example, the native cysteine residue at position C74 of CBeta may be present or absent in the engineered CBeta. In certain embodiments, the engineered CBeta in which the native cysteine residue C74 is absent comprises or is any one of SEQ ID NOs: 32-41.

Without wishing to be bound by any theory, but it is believed that the polypeptide complex provided herein is advantageous in that it tolerates both presence and absence of the native cysteine residue on the CBeta. Although it was suggested (see, for example, U.S. Pat. No. 7,666,604) that presence of the native cysteine residues on soluble TCR heterodimers is detrimental to the ligand binding ability of the TCR, the polypeptide complex provided herein can tolerate presence of this native cysteine residue without negatively affecting its antigen-binding activity. Furthermore, the polypeptide complex provided herein in the absence of the native cysteine residue expressed at high level, despite of the contrary teachings by Wu et al. *mAbs*, 7(2), pp. 364-376 (2005) that native disulphide bond in the TCR heterodimer is good for stabilizing the TCR heterodimer.

In certain embodiments, one or more native glycosylation site present in the native TCR constant regions may be modified (e.g. removed) or kept in the polypeptide complex provided in the present disclosure. The term "glycosylation site" as used herein with respect to a polypeptide sequence refers to an amino acid residue with a side chain to which a carbohydrate moiety (e.g. an oligosaccharide structure) can be attached. Glycosylation of polypeptides like antibodies is typically either N-linked or O-linked. N-linked refers to the attachment of the carbohydrate moiety to the side chain of an asparagine residue, for example, an asparagine residue in a tripeptide sequence such as asparagine-X-serine and asparagine-X-threonine, where X is any amino acid except proline. O-linked glycosylation refers to the attachment of one of the sugars N-aceylgalactosamine, galactose, or xylose to a hydroxyamino acid, most commonly to serine or threonine. Removal of native glycosylation sites can be conveniently accomplished by altering the amino acid sequence such that one or more of the above-described tripeptide sequences (for N-linked glycosylation sites) or one or more serine or threonine residues (for O-linked glycosylation sites) are substituted.

In certain embodiments, in the polypeptide complex provided herein, at least one native glycosylation site is absent or present in the engineered TCR constant regions, for example, in the first and/or the second TCR constant regions. Without wishing to be bound by any theory, but it is believed that the polypeptide complex provided herein can tolerate removal of all or part of the glycosylation sites without affecting the protein expression and stability, in contrast to existing teachings that presence of N-linked glycosylation sites on TCR constant region, such as CAlpha (i.e. N34, N68, and N79) and CBeta (i.e. N69) are necessary for protein expression and stability (see Wu et al., Mabs, 7:2, 364-376, 2015).

In certain embodiments, in the polypeptide complex provided herein, at least one of the N-glycosylation sites in the engineered CAlpha, e.g. N34, N68, N79 and N61 are absent or present. In certain embodiments, the engineered CAlpha sequences absent of a glycosylation site comprises or is any one of SEQ ID NOs: 44-48. In certain embodiments, at least one of the N-glycosylation sites in the engineered CBeta, e.g. N69, is absent or present. The engineered CBeta sequences (TRBC1) absent of glycosylation site comprises or is any one of SEQ ID NOs: 34-36. The engineered CBeta sequences (TRBC2) absent of a glycosylation site comprises or is any one of SEQ ID NOs: 38-40.

In certain embodiments, in the polypeptide complex provided herein, at least one of the N-glycosylation sites in the engineered CPre-Alpha, e.g. N50, is absent or present. The engineered CPre-Alpha sequence absent of a glycosylation site comprises or is SEQ ID NO: 83.

In certain embodiments, in the polypeptide complex provided herein, at least one of the N-glycosylation sites in the engineered CGamma, e.g. N65, is absent or present. In certain embodiments, the engineered CGamma sequence absent of a glycosylation site comprises or is SEQ ID NO: 114. In certain embodiments, at least one of the N-glycosylation sites in the engineered CDelta, e.g. N16 and N79 is absent or present. The engineered CDelta sequence absent of glycosylation site comprises or is SEQ ID NO: 116.

In certain embodiments, one or more native secondary structure present in the native TCR constant regions may be modified (e.g. removed) or kept in the polypeptide complex provided in the present disclosure. In certain embodiments, a native loop (such as FG loop and/or DE loop of native CBeta) is modified (e.g. removed) or kept in the polypeptide complex provided herein. The term "FG loop" and "DE loop" are structures mainly found in the TCR beta chain constant domain. The FG loop encompasses amino acid residues 101-117 of the native CBeta and is an unusually elongated, solvent-exposed structural element that forms one component of an alpha/beta TCR cavity against CD3. The DE loop encompasses amino acid residues 66-71 of the native CBeta. Alignment of sequence of TCR beta chain constant region with that of an immunoglobulin CH1 constant region revealed that the FG loop of TCR beta chain constant region are significantly longer. FIG. 3 shows the differences of constant regions between T cell beta chain and antibody heavy chain. In certain embodiments, the sequence at FG loop (YGLSENDEWTQDRAKPVT, SEQ ID NO: 79) is absent and/or replaced with YPSN (SEQ ID NO: 80). In certain embodiments, the sequence at native DE loop (QPALNDSR, SEQ ID NO: 88) is absent and/or replaced with QSGR (SEQ ID NO: 87). In certain embodiments, the CBeta sequences absent of native FG loop comprises or is any one of SEQ ID NOs: 37-40. In certain embodiments, the CBeta sequence absent of both native FG loop and native DE loop comprises or is SEQ ID NO: 41.

In the polypeptide complex provided herein, the constant regions derived from a TCR are operably linked to the variable regions derived from an antibody. The heavy chain or light chain variable region of an antibody can be operably linked to a TCR constant region, with or without a spacer.

In certain embodiments, the first antibody variable domain (VH) is fused to the first TCR constant region (C1) at a first conjunction domain, the first antibody variable domain (VL) is fused to the second TCR constant region (C2) at a second conjunction domain.

"Conjunction domain" as used herein refers to a boundary or border region where two amino acid sequences are fused or combined. In certain embodiments, the conjunction domain comprises at least a portion of C terminal fragment from a first fusion partner, fused to at least a portion of N terminal fragment from a second fusion partner, with or without a spacer in between. In such embodiments, the conjunction domain comprises fragments of both fusion partners, and the fusion point resides at the point where the two fragments link to each other, for example, directly or via a spacer. In certain other embodiments, the conjunction domain consists of a fragment of one fusion partner. In such embodiments, the fusion point could be at either end of the conjunction domain.

In certain embodiments, the first conjunction domain comprises at least a portion of the C terminal fragment of an antibody V/C conjunction, and at least a portion of the N-terminal fragment of a TCR V/C conjunction.

The term "antibody V/C conjunction" as used herein refers to the boundary of antibody variable domain and constant domain, for example, the boundary between heavy chain variable domain and the CH1 domain, or between light chain variable domain and the light chain constant domain. Similarly, the term "TCR V/C conjunction" refers to the boundary of TCR variable domain and constant domain, for example, the boundary between TCR Alpha variable domain and constant domain, or between TCR Beta variable domain and constant domain.

If the Fv region of an immunoglobulin is aligned with a TCR immunoglobulin-like domain, the antibody V/C conjunction and the TCR V/C conjunction would also be aligned. An example is given in Table 1 below, where antibody heavy chain V/C conjunction (SEQ ID NO: 270) is aligned to TCR Beta V/C conjunction (SEQ ID NO: 271) and antibody light chain V/C conjunction (SEQ ID NO: 272) is aligned to TCR Beta V/C conjunction (SEQ ID NO: 273).

The first and/or the second conjunction domains of the polypeptide complex as provided herein can be selected such that it comprises a proper length (e.g., 0, 1, 2, 3, 4, 5, 6, 7, 8, 9, or 10 amino acid residues) of the C terminal fragment of antibody V/C conjunction, and a proper length (e.g., 0, 1, 2, 3, 4, 5, 6, 7, 8, 9, or 10 amino acid residues) of the N terminal fragment of TCR V/C conjunction. For example, as shown in Table 1, the conjunction domain may be selected to have all sequence from the TCR V/C conjunction (see, e.g. SEQ ID NO: 145), or most sequence (see, e.g. SEQ ID NO: 147), or some sequence (see, e.g. SEQ ID NO: 146) from the TCR V/C conjunction. Still using Table 1 as an example, the conjunction domain may comprise more residues from TCR V/C conjunction than from antibody V/C conjunction (see, e.g. SEQ ID NO:147), or vice versa (see, e.g. SEQ ID NO:146).

In certain embodiments, the first and/or the second conjunction domains of the polypeptide complex as provided herein has a total length comparable to that of the antibody V/C conjunction or that of the TCR V/C conjunction.

A proper conjunction domain can be determined on a structural basis. For example, the three-dimensional structures of antibody and TCR may be superimposed, and overlappings of the antibody V/C conjunction and the TCR V/C conjunction on the superimposed structure may be determined and considered when determining the length or proportion of sequences from antibody or TCR V/C conjunction.

In certain embodiments, the first and/or the second conjunction domain comprises a spacer in between the fragments from antibody V/C conjunction and TCR V/C conjunction. Any suitable sequences or length of spacer sequences can be used, as long as it does not negatively affect the antigen binding or stability of the polypeptide complex.

Exemplary sequences of antibody variable/constant domain boundary, and TCR variable/constant domain boundary, and the antibody variable/TCR constant region boundary are provided in the below Tables 1-6.

In certain embodiments, C1 comprises an engineered CBeta and C2 comprises an engineered CAlpha. To illustrate, Table 1 shows the exemplary designs for the conjunction domains useful for antibody VH fused to TCR CBeta, or for antibody VL fused to TCR CAlpha. The antibody VH/constant domain boundary is aligned to TCR variable/CBeta boundary, and antibody VL/constant domain boundary is aligned to TCR variable/CAlpha boundary. Exemplary designs of the conjunction domains are also provided in an alignment form (see, e.g., SEQ ID NO: 144, 145, 146, or 147), with the first or the second conjunction domain shown with underline. In such embodiments, the first conjunction domain comprises or is SEQ ID NO: 49 or 50. In such embodiments, the second conjunction domain comprises or is SEQ ID NO: 51 or 52.

In certain embodiments, C1 comprises an engineered CAlpha and C2 comprises an engineered CBeta. Table 2 shows the exemplary designs for the conjunction domains useful for antibody VH fused to TCR CAlpha, or for antibody VL fused to TCR CBeta. The antibody VH/con-

TABLE 1

First and second conjunction domain designs for VH-CBeta/VL-CAlpha

| | Conjunction (heavy chain) | | | Conjunction (light chain) | |
|---|---|---|---|---|---|
| | Variable | Constant | | Variable | Constant |
| Antibody_VH SEQ ID NO: 270 | ......LVTVSS | AS--TKGPS...... | Antibody_VL SEQ ID NO: 272 | ......KVEIK | RTVAAPSVF...... |
| TCR_beta SEQ ID NO: 271 | ......RLTVLE | DLKNVFPPE...... | TCR_alpha SEQ ID NO: 273 | ......KLIIK | PDIQNPDPA...... |
| H_Conjunction_1 SEQ ID NO: 144 | ......LVTV<u>SS</u> | A<u>SKNVFPPE</u>...... | L_Conjunction_1 SEQ ID NO: 146 | ......KVEI<u>K</u> | RTVAA<u>PDPA</u>...... |
| H_Conjunction_2 SEQ ID NO: 145 | ......LVTV<u>LE</u> | <u>DLKNVFPPE</u>...... | L_Conjunction_2 SEQ ID NO: 147 | ......KVEI<u>K</u> | <u>PDIQNPDPA</u>...... | stant domain boundary is aligned to TCR variable/CAlpha boundary, and antibody VL/constant domain boundary is aligned to TCR variable/CBeta boundary. Exemplary designs of the conjunction domains are also provided in an alignment form (see, e.g., SEQ ID NO: 148, 149, or 150), with the first or the second conjunction domain shown with underline. In such embodiments, the first conjunction domain comprises or is SEQ ID NO: 129 or 130. In such embodiments, the second conjunction domain comprises or is SEQ ID NO: 49 or 50.

TABLE 2

First and second conjunction domain designs for VH-CAlpha/VL-CBeta

| | Conjunction (heavy chain) | | | Conjunction (light chain) | |
|---|---|---|---|---|---|
| | Variable | Constant | | Variable | Constant |
| Antibody_H SEQ ID NO: 274 | ......LVTVSS | --ASTKGPS...... | Antibody_L SEQ ID NO: 276 | ......KVEIK-- | RT---VAAPSVF...... |
| TCR_alpha SEQ ID NO: 275 | ......KLIIK-- | PDIQNPDPA...... | TCR_beta SEQ ID NO: 277 | ......RLTVLE | -DLKNVEPPE...... |
| H_Conjunction_3 SEQ ID NO: 148 | ......LVTV<u>SS</u> | A<u>S</u>IQNPDPA...... | L_Conjunction_3 SEQ ID NO: 150 | ......KVEI<u>KLE</u> | -DLKNVEPPE...... |
| H_Conjunction_4 SEQ ID NO: 149 | ......LVTV<u>SS</u> | PDIQNPDPA...... | L_Conjunction_4 SEQ ID NO: 150 | ......KVEI<u>KLE</u> | -DLKNVEPPE...... |

In certain embodiments, C1 comprises an engineered CBeta and C2 comprises an engineered CPre-Alpha. Table 3 shows the exemplary designs for the conjunction domains useful for antibody VH fused to TCR CBeta, or for antibody VL fused to TCR CPre-Alpha. The antibody VH/constant domain boundary is aligned to TCR variable/CBeta boundary, and antibody VL/constant domain boundary is aligned to TCR variable/CPre-Alpha boundary. Exemplary designs of the conjunction domains are also provided in an alignment form (see, e.g., SEQ ID NO: 170, 171, 169, or 156), with the first or the second conjunction domain shown with underline. In such embodiments, the first conjunction domain comprises or is SEQ ID NO: 49 or 50. In such embodiments, the second conjunction domain comprises or is SEQ ID NO: 81 or 131.

TABLE 3

First and second conjunction domain designs for VH-CBeta/VL-CPre-Alpha

| | Conjunction (heavy chain) | | | Conjunction (light chain) | |
|---|---|---|---|---|---|
| | Variable | Constant | | Variable | Constant |
| Antibody_H SEQ ID NO: 283 | ......LVTVSS | AS--TKGPS...... | Antibody_L SEQ ID NO: 285 | ......KVEIK | RTVAAPSVF...... |
| TCR_beta SEQ ID NO: 284 | ......RLTVLE | DLKNVFPPE...... | TCR_alpha SEQ ID NO: 286 | ......KLIIK | PDIQNPDPA...... |
| | | | Pre-TCR_alpha SEQ ID NO: 287 | ......GCPAL | PTGVGGTPF...... |
| H_Conjunction_A SEQ ID NO: 170 | ......LVTV<u>SS</u> | A<u>S</u>KNVFPPE...... | L_Conjunction_A SEQ ID NO: 169 | ......KVEI<u>K</u> | RTVAAGTPF...... |
| H_Conjunction_B SEQ ID NO: 171 | ......LVTV<u>LE</u> | DLKNVFPPE...... | L_Conjunction_B SEQ ID NO: 156 | ......KVEI<u>K</u> | PTGVGGTPF...... |

In certain embodiments, C1 comprises an engineered CPre-Alpha and C2 comprises an engineered CBeta. Table 4 shows the exemplary designs for the conjunction domains useful for antibody VH fused to TCR CPre-Alpha, or for antibody VL fused to TCR CBeta. The antibody VH/constant domain boundary is aligned to TCR variable/CPre-Alpha boundary, and antibody VL/constant domain boundary is aligned to TCR variable/CBeta boundary. Exemplary designs of the conjunction domains are also provided in an alignment form (see, e.g., SEQ ID NO: 172, 173, 174, or 175), with the first or the second conjunction domain shown with underline. In such embodiments, the first conjunction domain comprises or is SEQ ID NO: 81, 131, 132, or 133. In such embodiments, the second conjunction domain comprises or is SEQ ID NO: 49 or 50.

TABLE 4

First and second conjunction domain designs for VH-CPre-Alpha/VL-CBeta

| | Conjunction (heavy chain) | | | Conjunction (light chain) | |
|---|---|---|---|---|---|
| | Variable | Constant | | Variable | Constant |
| Antibody_H SEQ ID NO: 288 | ......LVTVSS | --ASTKGPS...... | Antibody_L SEQ ID NO: 291 | ......KVEIK-- | RTVAAPSVF...... |
| TCR-alpha SEQ ID NO: 289 | ......KLIIK-- | PDIQNPDPA...... | TCR_beta SEQ ID NO: 292 | ......RLTVLE | -DLKNVEPPE...... |
| Pre-TCR_alpha SEQ ID NO: 290 | ......GCPAL-- | PTGVGGTPF...... | | | |
| H_Conjunction_C SEQ ID NO: 172 | ......LVTV<u>SS</u> | <u>AS</u>GVGGTPF...... | L_Conjunction_C SEQ ID NO: 174 | ......KVEI<u>KLE</u> | <u>-DLKNVEPPE</u>...... |
| H_Conjunction_D SEQ ID NO: 173 | ......LVTV<u>SS</u> | PTGVGGTPF...... | L_Conjunction_D SEQ ID NO: 175 | ......KVEI<u>KLE</u> | <u>-DLKNVEPPE</u>...... |

In certain embodiments, C1 comprises an engineered CGamma and C2 comprises an engineered CDelta. Table 5 shows the exemplary designs for the conjunction domains useful for antibody VH fused to TCR CGamma, or for antibody VL fused to TCR CDelta. The antibody VH/constant domain boundary is aligned to TCR variable/CGamma boundary, and antibody VL/constant domain boundary is aligned to TCR variable/CDelta boundary. Exemplary designs of the conjunction domains are also provided in an alignment form (see, e.g., SEQ ID NO: 157, 158, 159, or 160), with the first or the second conjunction domain shown with underline. In such embodiments, the first conjunction domain comprises or is SEQ ID NO: 117 or 118. In such embodiments, the second conjunction domain comprises or is SEQ ID NO: 119 or 120.

TABLE 5

First and second conjunction domain designs for VH-CGamma/VL-CDelta

| | Conjunction (heavy chain) | | | Conjunction (light chain) | |
|---|---|---|---|---|---|
| | Variable | Constant | | Variable | Constant |
| Antibody_H SEQ ID NO: 293 | ......LVTVSS | AS--TK-GPS...... | Antibody_L SEQ ID NO: 143 | ......KVEIK | ---RTVAAPSVF...... |
| TCR_gamma SEQ ID NO: 142 | ......TLVVTD | KQLDADVSPK...... | TCR_delta SEQ ID NO: 55 | ......RVTVE | PRSQPHTKPSVF...... |
| H_Conjunction_4 SEQ ID NO: 157 | ......LVTV<u>SS</u> | <u>AS</u>LDADVSPK...... | L_Conjunction_4 SEQ ID NO: 159 | ......KVEI<u>K</u> | PRSQPHTKPSVF...... |
| H_Conjunction_5 SEQ ID NO: 158 | ......LVTV<u>TD</u> | KQLDADVSPK...... | L_Conjunction_5 SEQ ID NO: 160 | ......KVEI<u>E</u> | PRSQPHTKPSVF...... |

In certain embodiments, C1 comprises an engineered CDelta and C2 comprises an engineered CGamma. Table 6 shows the exemplary designs for the conjunction domains useful for antibody VH fused to TCR CDelta, or for antibody VL fused to TCR CGamma. The antibody VH/constant domain boundary is aligned to TCR variable/CDelta boundary, and antibody VL/constant domain boundary is aligned to TCR variable/CGamma boundary. Exemplary designs of the conjunction domains are also provided in an alignment form (see, e.g., SEQ ID NO: 161, 162, 163, or 164), with the first or the second conjunction domain shown with underline. In such embodiments, the first conjunction domain comprises or is SEQ ID NO: 123 or 124. In such embodiments, the second conjunction domain comprises or is SEQ ID NO: 125 or 126.

NOs: 311, 312, 313, 314, 315, 316, 317, and 318, the HCJ comprises or is a sequence selected from a group consisting of: SEQ ID NOs: 49 and 50; LCJ comprises or is a sequence selected from a group consisting of: SEQ ID NOs: 81 and 131.

In certain embodiments, C1 is an engineered CPre-Alpha which comprises or is a sequence selected from a group consisting of: SEQ ID NOs: 311, 312, 313, 314, 315, 316, 317, and 318, and C2 is an engineered CBeta which comprises or is a sequence selected from a group consisting of: SEQ ID NOs: 32-41, the HCJ comprises or is a sequence selected from a group consisting of: SEQ ID NOs: 81, 131, 132, and 133; LCJ comprises or is a sequence selected from a group consisting of: SEQ ID NOs: 49 and 50.

TABLE 6

First and second conjunction domain designs for VH-CDelta/VL-CGamma

| | Conjunction (heavy chain) | | | Conjunction (light chain) | |
|---|---|---|---|---|---|
| | Variable | Constant | | Variable | Constant |
| Antibody_H SEQ ID NO: 56 | ......LVTVSS | --ASTKGPS...... | Antibody_L SEQ ID NO: 58 | ......KVEIK- | RTV---AAPSVF...... |
| TCR_delta SEQ ID NO: 57 | ......RVTVEP | RSQPHTKPS...... | TCR_gamma SEQ ID NO: 59 | ......TLVVTD | KQLDADVSPKPT...... |
| H_Conjunction_6 SEQ ID NO: 161 | ......LVTV<u>SS</u> | RSQPHTKPS...... | L_Conjunction_6 SEQ ID NO: 163 | ......KVEI<u>KD</u> | KQLDADVSPKPT...... |
| H_Conjunction_7 SEQ ID NO: 162 | ......LVTVEP | RSQPHTKPS...... | L_Conjunction_7 SEQ ID NO: 164 | ......KVEITD | KQLDADVSPKPT...... |

In certain embodiments, the first polypeptide comprises a sequence comprising domains operably linked as in formula (I): VH-HCJ-C1, and the second polypeptide comprises a sequence comprising domains operably linked as in formula (II): VL-LCJ-C2, wherein:
 VH is a heavy chain variable domain of an antibody;
 HCJ is a first conjunction domain as defined supra;
 C1 is a first TCR constant domain as defined supra;
 VL is a light chain variable domain of an antibody;
 LCJ is a second conjunction domain as defined supra;
 C2 is a second TCR constant domain as defined supra.

In certain embodiments, C1 is an engineered CAlpha which comprises or is a sequence selected from a group consisting of: SEQ ID NOs: 42-48, and C2 is an engineered CBeta which comprises or is a sequence selected from a group consisting of: SEQ ID NOs: 32-41, the HCJ comprises or is a sequence selected from a group consisting of: SEQ ID NOs: 49 and 50; LCJ comprises or is a sequence selected from a group consisting of: SEQ ID NOs: 51 and 52.

In certain embodiments, C1 is an engineered CBeta which comprises or is a sequence selected from a group consisting of: SEQ ID NOs: 32-41, and C2 is an engineered CAlpha which comprises or is a sequence selected from a group consisting of: SEQ ID NOs: 42-48, the HCJ comprises or is a sequence selected from a group consisting of: SEQ ID NOs: 129 and 130; LCJ comprises or is a sequence selected from a group consisting of: SEQ ID NOs: 49 and 50.

In certain embodiments, C1 is an engineered CBeta which comprises or is a sequence selected from a group consisting of: SEQ ID NOs: 32-41, 84, 319, 320, 321, 322, 323, and 324, and C2 is an engineered CPre-Alpha which comprises or is a sequence selected from a group consisting of: SEQ ID In certain embodiments, C1 is an engineered CGamma which comprises or is a sequence selected from a group consisting of: SEQ ID NOs: 113, 114, 333, 334, 335, 336, 337, 338, 339, and 340, and C2 is an engineered CDelta which comprises or is a sequence selected from a group consisting of: SEQ ID NOs: 325, 326, 327, 328, 329, 330, 331, and 332, the HCJ comprises or is a sequence selected from a group consisting of: SEQ ID NOs: 117 and 118; LCJ comprises or is a sequence selected from a group consisting of: SEQ ID NOs: 119 and 120.

In certain embodiments, C1 is an engineered CDelta which comprises or is a sequence selected from a group consisting of: SEQ ID NOs: 325, 326, 327, 328, 329, 330, 331, and 332, and C2 is an engineered CGamma which comprises or is a sequence selected from a group consisting of: SEQ ID NOs: 113, 114, 333, 334, 335, 336, 337, 338, 339, and 340, the HCJ comprises or is a sequence selected from a group consisting of: SEQ ID NOs: 123 and 124; LCJ comprises or is a sequence selected from a group consisting of: SEQ ID NOs: 125 and 126.

U.S. Pat. No. 9,683,052 discloses that certain residues within the contact interface between TCR constant regions can be engineered into an Fc region to facilitate the heterodimeric pairing of two heavy chains. Such residues and/or corresponding residues within the contact interface between TCR constant regions disclosed herein can also be engineered into a Fab region, e.g., the CH1 and CL domains, to facilitate the pairing between a light chain and a heavy chain.

ii. Antibody Variable Region

The polypeptide complex provided herein comprises a first heavy chain variable domain (VH) and a first light chain variable domain (VL) of the first antibody. In a conventional native antibody, a variable region comprises three CDR regions interposed by flanking framework (FR) regions, for example, as set forth in the following formula: FR1-CDR1-FR2-CDR2-FR3-CDR3-FR4, from N-terminus to C-terminus. The polypeptide complex provided herein can comprise but is not limited to such a conventional antibody variable region. For example, the variable domain may comprise all three or less than three of the CDRs, with all four or less than four of the FRs of the antibody heavy or light chain, as long as the variable domain is capable of specifically binding to an antigen.

The first antibody has a first antigenic specificity. In other words, VH and VL form an antigen-binding site which can specifically bind to an antigen or an epitope. The antigenic specificity can be directed to any suitable antigen or epitope, for example, one that is exogenous antigen, endogenous antigen, autoantigen, neoantigen, viral antigen or tumor antigen. An exogenous antigen enters a body by inhalation, ingestion or injection, and can be presented by the antigen-presenting cells (APCs) by endocytosis or phagocytosis and form MHC II complex. An endogenous antigen is generated within normal cells as a result of cell metabolism, intracellular viral or bacterial infection, which can form MHC I complex. An autoantigen (e.g. peptide, DNA or RNA, etc.) is recognized by the immune system of a patient suffering from autoimmune diseases, whereas under normal condition, this antigen should not be the target of the immune system. A neoantigen is entirely absent from the normal body, and is generated because of a certain disease, such as tumor or cancer. In certain embodiments, the antigen is associated with a certain disease (e.g. tumor or cancer, autoimmune diseases, infectious and parasitic diseases, cardiovascular diseases, neuropathies, neuropsychiatric conditions, injuries, inflammations, coagulation disorder). In certain embodiments, the antigen is associated with immune system (e.g. immunological cells such as B cell, T cell, NK cells, macrophages, etc.).

In certain embodiments, the first antigenic specificity is directed to an immune-related antigen or an epitope thereof. Examples of an immune-related antigen include a T-cell specific receptor molecule and/or a natural killer cell (NK cell) specific receptor molecule.

The T-cell specific receptor molecule allows a T cell to bind to and, if additional signals are present, to be activated by and respond to an epitope/antigen presented by another cell called the antigen-presenting cell or APC. The T-cell specific receptor molecule can be TCR, CD3, CD28, CD134 (also termed OX40), 4-1 BB, CD5, and CD95 (also known as the Fas receptor).

Examples of a NK cell specific receptor molecule include CD16, a low affinity Fc receptor and NKG2D, and CD2.

In certain embodiments, the first antigenic specificity is directed to a tumor-associated antigen or an epitope thereof. The term "tumor associated antigen" refers to an antigen that is or can be presented on a tumor cell surface and that is located on or within tumor cells. In some embodiments, the tumor associated antigens can be presented only by tumor cells and not by normal, i.e. non-tumor cells. In some other embodiments, the tumor associated antigens can be exclusively expressed on tumor cells or may represent a tumor specific mutation compared to non-tumor cells. In some other embodiments, the tumor associated antigens can be found in both tumor cells and non-tumor cells, but is overexpressed on tumor cells when compared to non-tumor cells or are accessible for antibody binding in tumor cells due to the less compact structure of the tumor tissue compared to non-tumor tissue. In some embodiments the tumor associated antigen is located on the vasculature of a tumor.

Illustrative examples of a tumor associated surface antigen are CD10, CD19, CD20, CD22, CD21, CD22, CD25, CD30, CD33, CD34, CD37, CD44v6, CD45, CD133, Fms-like tyrosine kinase 3 (FLT-3, CD135), chondroitin sulfate proteoglycan 4 (CSPG4, melanoma-associated chondroitin sulfate proteoglycan), Epidermal growth factor receptor (EGFR), Her2neu, Her3, IGFR, IL3R, fibroblast activating protein (FAP), CDCP1, Derlin1, Tenascin, frizzled 1-10, the vascular antigens VEGFR2 (KDR/FLK1), VEGFR3 (FLT4, CD309), PDGFR-alpha (CD140a), PDGFR-beta (CD140b) Endoglin, CLEC14, Tem1-8, and Tie2. Further examples may include A33, CAMPATH-1 (CDw52), Carcinoembryonic antigen (CEA), Carboanhydrase IX (MN/CA IX), de2-7 EGFR, EGFRvIII, EpCAM, Ep-CAM, Folate-binding protein, G250, Fms-like tyrosine kinase 3 (FLT-3, CD135), c-Kit (CD117), CSF1R (CD115), HLA-DR, IGFR, IL-2 receptor, IL3R, MCSP (Melanoma-associated cell surface chondroitin sulfate proteoglycane), Muc-1, Prostate-specific membrane antigen (PSMA), Prostate stem cell antigen (PSCA), Prostate specific antigen (PSA), and TAG-72.

In certain embodiments, the first antigenic specificity is directed to an antigen or an epitope thereof, selected from the group consisting of: CD3, 4.1BB (CD137), OX40 (CD134), CD16, CD47, CD19, CD20, CD22, CD33, CD38, CD123, CD133, CEA, cdH3, EpCAM, epidermal growth factor receptor (EGFR), EGFRvIII (a mutant form of EGFR), HER2, HER3, dLL3, BCMA, Sialyl-Lea, 5T4, ROR1, melanoma-associated chondroitin sulfate proteoglycan, mesothelin, folate receptor 1, VEGF receptor, EpCAM, HER2/neu, HER3/neu, G250, CEA, MAGE, proteoglycans, VEGF, FGFR, alphaVbeta3-integrin, HLA, HLA-DR, ASC, CD1, CD2, CD4, CD5, CD6, CD7, CD8, CD11, CD13, CD14, CD21, CD23, CD24, CD28, CD30, CD37, CD40, CD41, CD44, CD52, CD64, c-erb-2, CALLA, MHCII, CD44v3, CD44v6, p97, ganglioside GM1, GM2, GM3, GD1a, GD1b, GD2, GD3, GT1b, GT3, GQ1, NY-ESO-1, NFX2, SSX2, SSX4 Trp2, gp100, tyrosinase, Muc-1, telomerase, survivin, G250, p53, CA125 MUC, Wue antigen, Lewis Y antigen, HSP-27, HSP-70, HSP-72, HSP-90, Pgp, MCSP, EpHA2 and cell surface targets GC182, GT468 or GT512.

The antibody variable domains can be derived from a parent antibody. A parent antibody can be any type of antibody, including for example, a fully human antibody, a humanized antibody, or an animal antibody (e.g. mouse, rat, rabbit, sheep, cow, dog, etc.). The parent antibody can be a monoclonal antibody or a polyclonal antibody.

In certain embodiments, the parent antibody is a monoclonal antibody. A monoclonal antibody can be produced by various methods known in the art, for example, hybridoma technology, recombinant method, phage display, or any combination thereof.

Hybridoma technology involves fusion of antibody-expressing B cells with an immortal B cell line to produce hybridomas, which are further screened for desirable characteristics such as high production level of antibody production, good growth of hybridoma cells, and strong binding or good biological activity of the antibody (see, for example, Harlow et al., (1988) Antibodies: A Laboratory Manual, (Cold Spring Harbor Laboratory Press, 2nd ed.).

Recombinant method is another way to produce a parent antibody. Briefly, cells such as lymphocytes secreting antibodies of interest are obtained and identified and single cells are isolated, followed by reverse transcriptase PCR to produce heavy- and light-chain variable region cDNAs. These cDNA sequences of the variable regions can be used to construct the encoding sequence of the polypeptide complex provided herein, and then expressed in a suitable host cell (for reviews, please see, for example, U.S. Pat. No. 5,627,052; PCT Publication No. WO 92/02551; and Babcock et al., (1996) Proc. Natl. Acad. Sci. USA 93:7843-7848).

Antibody libraries are still an alternative for obtaining a parent antibody. Briefly, one can screen an antibody library to identify an antibody having the desired binding specificity. Methods for such screening of recombinant antibody libraries are well known in the art and include methods described in, for example, U.S. Pat. No. 5,223,409; PCT Publication Nos. WO 92/18619; WO 91/17271; WO 92/20791; WO 92/15679; WO 93/01288; WO 92/01047; WO 92/09690; and WO 97/29131; Fuchs et al., (1991) Bio/Technology 9:1370-1372; Hay et al., (1992) Hum. Antibod. Hybridomas 3:81-85; Huse et al., (1989) Science 246:1275-1281; McCafferty et al., (1990) Nature 348:552-554; Griffiths et al., (1993) EMBO J. 12:725-734; Hawkins et al., (1992) J. Mol. Biol. 226:889-896; Clackson et al., (1991) Nature 352:624-628; Gram et al., (1992) Proc. Natl. Acad. Sci. USA 89:3576-3580; Garrad et al., (1991) Bio/Technology 9:1373-1377; Hoogenboom et al., (1991) Nucl. Acid Res. 19:4133-4137; and Barbas et al., (1991) Proc. Natl. Acad. Sci. USA 88:7978-7982; and US Patent Application Publication No. 20030186374.

Another illustrative method to obtain a parent antibody is phage display (see, e.g., Brinkman et al., (1995) J. Immunol. Methods 182:41-50; Ames et al., (1995) J. Immunol. Methods 184:177-186; Kettleborough et al., (1994) Eur. J. Immunol. 24:952-958; Persic et al., (1997) Gene 187 9-18; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743; and 5,969,108). Polynucleotide sequences encoding antibody domains are introduced to phage particles to generate a library of phage particles displaying a variety of functional antibody domains. Fd and M13 are filamentous phage commonly used, and the functional antibody domains displayed on the phage particles can be, for example, Fab, Fv or disulphide stabilized Fv antibody domains, which is recombinantly fused to a phage protein encoded by gene III or gene VIII. The phage library can be screened using an antigen of interest, for example, which is optionally labeled or bound or captured to a solid substrate (e.g. a bead). For a selected phage, its polynucleotide sequences encoding the antibody variable domains are obtained and used in the construction of the polypeptide complex provided herein. Likewise, a library of yeast can be generated displaying antibody variable domains by tethering the antibody domains to the yeast cell wall (see, for example, U.S. Pat. No. 6,699,658), and then screened with a bound antigen to obtain a parent antibody useful for construction of the polypeptide complex provided herein.

Furthermore, a parent antibody can also be produced by injecting an antigen of interest to a transgenic non-human animal comprising some, or all, of the human immunoglobulin locus, for example, OmniRat, OmniMouse (see, for example, Osborn M. et al., Journal of Immunology, 2013, 190: 1481-90; Ma B. et al., Journal of Immunological Methods 400-401 (2013) 78-86; Geurts A. et al., Science, 2009, 325:433; U.S. Pat. No. 8,907,157; EP patent 2152880B1; EP patent 2336329B1), HuMab mice (see, for details, Lonberg, N. et al., Nature 368(6474): 856 859 (1994)), Xeno-Mouse (Mendez et al., Nat Genet., 1997, 15:146-156), TransChromo Mouse (Ishida et al., Cloning Stem Cells, 2002, 4:91-102) and VelocImmune Mouse (Murphy et al., Proc Natl Acad Sci USA, 2014, 111:5153-5158), Kymouse (Lee et al., Nat Biotechnol, 2014, 32:356-363), and transgenic rabbit (Flisikowska et al., PLoS One, 2011, 6:e21045).

The parent antibodies described herein can be further modified, for example, to graft the CDR sequences to a different framework or scaffold, to substitute one or more amino acid residues in one or more framework regions, to replace one or more residues in one or more CDR regions for affinity maturation, and so on. These can be accomplished by a person skilled in the art using conventional techniques.

The parent antibody can also be a therapeutic antibody known in the art, for example those approved by FDA for therapeutic or diagnostic use, or those under clinical trial for treating a condition, or those in research and development. Polynucleotide sequences and protein sequences for the variable regions of known antibodies can be obtained from public databases such as, for example, e.g., www.ncbi.nlm nih gov/entrez-/query.fcgi; www.atcc.org/phage/hdb.html; www.sciquest.com/; www.abcam.com/; www.antibodyresource.com/onlinecomp.html.

Examples of therapeutic antibodies include, but are not limited to, rituximab (Rituxan, IDEC/Genentech/Roche) (see for example U.S. Pat. No. 5,736,137), a chimeric anti-CD20 antibody approved to treat Non-Hodgkin's lymphoma; HuMax-CD20, an anti-CD20 currently being developed by Genmab, an anti-CD20 antibody described in U.S. Pat. No. 5,500,362, AME-133 (Applied Molecular Evolution), hA20 (Immunomedics, Inc.), HumaLYM (Intracel), and PRO70769 (PCT Application No. PCT/US2003/040426), trastuzumab (Herceptin, Genentech) (see for example U.S. Pat. No. 5,677,171), a humanized anti-Her2/neu antibody approved to treat breast cancer; pertuzumab (rhuMab-2C4, Omnitarg), currently being developed by Genentech; an anti-Her2 antibody described in U.S. Pat. No. 4,753,894; cetuximab (Erbitux, Imclone) (U.S. Pat. No. 4,943,533; PCT Publication No. WO 96/40210), a chimeric anti-EGFR antibody in clinical trials for a variety of cancers; ABX-EGF (U.S. Pat. No. 6,235,883), currently being developed by Abgenix-Immunex-Amgen; HuMax-EGFr (U.S. Pat. No. 7,247,301), currently being developed by Genmab; 425, EMD55900, EMD62000, and EMD72000 (Merck KGaA) (U.S. Pat. No. 5,558,864; Murthy et al., (1987) Arch. Biochem. Biophys. 252(2):549-60; Rodeck et al., (1987) J. Cell. Biochem. 35(4):315-20; Kettleborough et al., (1991) Protein Eng. 4(7):773-83); ICR62 (Institute of Cancer Research) (PCT Publication No. WO 95/20045; Modjtahedi et al., (1993) J. Cell Biophys. 22(1-3):129-46; Modjtahedi et al., (1993) Br. J. Cancer 67(2):247-53; Modjtahedi et al., (1996) Br. J. Cancer 73(2):228-35; Modjtahedi et al., (2003) Int. J. Cancer 105(2):273-80); TheraCIM hR3 (YM Biosciences, Canada and Centro de Immunologia Molecular, Cuba (U.S. Pat. Nos. 5,891,996; 6,506,883; Mateo et al., (1997) Immunotechnol. 3(1):71-81); mAb-806 (Ludwig Institute for Cancer Research, Memorial Sloan-Kettering) (Jungbluth et al., (2003) Proc. Natl. Acad. Sci. USA 100(2):639-44); KSB-102 (KS Biomedix); MR1-1 (IVAX, National Cancer Institute) (PCT Publication No. WO 0162931); and SC100 (Scancell) (PCT WO 01/88138); alemtuzumab (Campath, Millenium), a humanized mAb currently approved for treatment of B-cell chronic lymphocytic leukemia; muromonab-CD3 (Orthoclone OKT3), an anti-CD3 antibody developed by Ortho Biotech/Johnson & Johnson, ibritumomab tiuxetan (Zevalin), an anti-CD20 antibody developed by IDEC/Schering AG, gemtuzumab ozogamicin (Mylotarg), an anti-CD33 (p67 protein) antibody developed by Celltech/Wyeth, alefacept (Amevive), an anti-LFA-3 Fc fusion developed by Biogen), abciximab (ReoPro), developed by Centocor/Lilly, basiliximab (Simulect), developed by Novartis, palivizumab (Synagis), developed by Medimmune, infliximab (Remicade), an anti-TNFalpha antibody developed by Centocor, adalimumab (Humira), an anti-TNFalpha antibody developed by Abbott, Humicade, an anti-TNFalpha antibody developed by Celltech, golimumab (CNTO-148), a fully human TNF antibody developed by Centocor, etanercept (Enbrel), an p75 TNF receptor Fc fusion developed by Immunex/Amgen, lenercept, an p55TNF receptor Fc fusion previously developed by Roche, ABX-CBL, an anti-CD147 antibody being developed by Abgenix, ABX-IL8, an anti-IL8 antibody being developed by Abgenix, ABX-MA1, an anti-MUC18 antibody being developed by Abgenix, Pemtumomab (R1549, 90Y-muHMFG1), an anti-MUC1 in development by Antisoma, Therex (R1550), an anti-MUC1 antibody being developed by Antisoma, AngioMab (AS1405), being developed by Antisoma, HuBC-1, being developed by Antisoma, Thioplatin (AS1407) being developed by Antisoma, Antegren (natalizumab), an anti-alpha-4-beta-1 (VLA-4) and alpha-4-beta-7 antibody being developed by Biogen, VLA-1 mAb, an anti-VLA-1 integrin antibody being developed by Biogen, LTBR mAb, an anti-lymphotoxin beta receptor (LTBR) antibody being developed by Biogen, CAT-152, an anti-TGF-.beta.2 antibody being developed by Cambridge Antibody Technology, ABT 874 (J695), an anti-IL-12 p40 antibody being developed by Abbott, CAT-192, an anti-TGF.beta.1 antibody being developed by Cambridge Antibody Technology and Genzyme, CAT-213, an anti-Eotaxin1 antibody being developed by Cambridge Antibody Technology, LymphoStat-B an anti-Blys antibody being developed by Cambridge Antibody Technology and Human Genome Sciences Inc., TRAIL-R1mAb, an anti-TRAIL-R1 antibody being developed by Cambridge Antibody Technology and Human Genome Sciences, Inc., Avastin bevacizumab, rhuMAb-VEGF), an anti-VEGF antibody being developed by Genentech, an anti-HER receptor family antibody being developed by Genentech, Anti-Tissue Factor (ATF), an anti-Tissue Factor antibody being developed by Genentech, Xolair (Omalizumab), an anti-IgE antibody being developed by Genentech, Raptiva (Efalizumab), an anti-CD11a antibody being developed by Genentech and Xoma, MLN-02 Antibody (formerly LDP-02), being developed by Genentech and Millenium Pharmaceuticals, HuMax CD4, an anti-CD4 antibody being developed by Genmab, HuMax-IL15, an anti-IL15 antibody being developed by Genmab and Amgen, HuMax-Inflam, being developed by Genmab and Medarex, HuMax-Cancer, an anti-Heparanase I antibody being developed by Genmab and Medarex and Oxford GcoSciences, HuMax-Lymphoma, being developed by Genmab and Amgen, HuMax-TAC, being developed by Genmab, IDEC-131, and anti-CD40L antibody being developed by IDEC Pharmaceuticals, IDEC-151 (Clenoliximab), an anti-CD4 antibody being developed by IDEC Pharmaceuticals, IDEC-114, an anti-CD80 antibody being developed by IDEC Pharmaceuticals, IDEC-152, an anti-CD23 being developed by IDEC Pharmaceuticals, anti-macrophage migration factor (MIF) antibodies being developed by IDEC Pharmaceuticals, BEC2, an anti-idiotypic antibody being developed by Imclone, IMC-1C11, an anti-KDR antibody being developed by Imclone, DC101, an anti-flk-1 antibody being developed by Imclone, anti-VE cadherin antibodies being developed by Imclone, CEA-Cide (labetuzumab), an anti-carcinoembryonic antigen (CEA) antibody being developed by Immunomedics, LymphoCide (Epratuzumab), an anti-CD22 antibody being developed by Immunomedics, AFP-Cide, being developed by Immunomedics, MyelomaCide, being developed by Immunomedics, LkoCide, being developed by Immunomedics, ProstaCide, being developed by Immunomedics, MDX-010, an anti-CTLA4 antibody being developed by Medarex, MDX-060, an anti-CD30 antibody being developed by Medarex, MDX-070 being developed by Medarex, MDX-018 being developed by Medarex, Osidem (IDM-1), and anti-Her2 antibody being developed by Medarex and Immuno-Designed Molecules, HuMax-CD4, an anti-CD4 antibody being developed by Medarex and Genmab, HuMax-IL15, an anti-IL15 antibody being developed by Medarex and Genmab, CNTO 148, an anti-TNF.alpha. antibody being developed by Medarex and Centocor/J&J, CNTO 1275, an anti-cytokine antibody being developed by Centocor/J&J, MOR101 and MOR102, anti-intercellular adhesion molecule-1 (ICAM-1) (CD54) antibodies being developed by MorphoSys, MOR201, an anti-fibroblast growth factor receptor 3 (FGFR-3) antibody being developed by MorphoSys, Nuvion (visilizumab), an anti-CD3 antibody being developed by Protein Design Labs, HuZAF, an anti-gamma interferon antibody being developed by Protein Design Labs, Anti-.alpha. 5.beta.1 Integrin, being developed by Protein Design Labs, anti-IL-12, being developed by Protein Design Labs, ING-1, an anti-Ep-CAM antibody being developed by Xoma, Xolair (Omalizumab) a humanized anti-IgE antibody developed by Genentech and Novartis, and MLN01, an anti-Beta2 integrin antibody being developed by Xoma. In another embodiment, the therapeutics include KRN330 (Kirin); huA33 antibody (A33, Ludwig Institute for Cancer Research); CNTO 95 (alpha V integrins, Centocor); MEDI-522 (alpha V.beta.3 integrin, Medimmune); volociximab (alpha V.beta.1 integrin, Biogen/PDL); Human mAb 216 (B cell glycosolated epitope, NCI); BiTE MT103 (bispecific CD19 CD3, Medimmune); 4G7 H22 (Bispecific Bcell.times.FcgammaR1, Medarex/Merck KGa); rM28 (Bispecific CD28.times.MAPG, EP Patent No. EP1444268); MDX447 (EMD 82633) (Bispecific CD64 EGFR, Medarex); Catumaxomab (removab) (Bispecific EpCAM anti-CD3, Trion/Fres); Ertumaxomab (bispecific HER2/CD3, Fresenius Biotech); oregovomab (OvaRex) (CA-125, ViRexx); Rencarex (WX G250) (carbonic anhydrase IX, Wilex); CNTO 888 (CCL2, Centocor); TRC105 (CD105 (endoglin), Tracon); BMS-663513 (CD137 agonist, Brystol Myers Squibb); MDX-1342 (CD19, Medarex); Siplizumab (MEDI-507) (CD2, Medimmune); Ofatumumab (Humax-CD20) (CD20, Genmab); Rituximab (Rituxan) (CD20, Genentech); veltuzumab (hA20) (CD20, Immunomedics); Epratuzumab (CD22, Amgen); lumiliximab (IDEC 152) (CD23, Biogen); muromonab-CD3 (CD3, Ortho); HuM291 (CD3 fc receptor, PDL Biopharma); HeFi-1, CD30, NCI); MDX-060 (CD30, Medarex); MDX-1401 (CD30, Medarex); SGN-30 (CD30, Seattle Genentics); SGN-33 (Lintuzumab) (CD33, Seattle Genentics); Zanolimumab (HuMax-CD4) (CD4, Genmab); HCD122 (CD40, Novartis); SGN-40 (CD40, Seattle Genentics); Campathlh (Alemtuzumab) (CD52, Genzyme); MDX-1411 (CD70, Medarex); hLL1 (EPB-1) (CD74.38, Immunomedics); Galiximab (IDEC-144) (CD80, Biogen); MT293 (TRC093/D93) (cleaved collagen, Tracon); HuLuc63 (CS1, PDL Pharma); ipilimumab (MDX-010) (CTLA4, Brystol Myers Squibb); Tremelimumab (Ticilimumab, CP-675,2) (CTLA4, Pfizer); HGS-ETR1 (Mapatumumab) (DR4 TRAIL-R1 agonist, Human Genome Science/Glaxo Smith Kline); AMG-655 (DR5, Amgen); Apomab (DR5, Genentech); CS-1008 (DR5, Daiichi Sankyo); HGS-ETR2 (lexatumumab) (DR5 TRAIL-R2 agonist, HGS); Cetuximab (Erbitux) (EGFR, Imclone); IMC-11F8, (EGFR, Imclone); Nimotuzumab (EGFR, YM Bio); Panitumumab (Vectabix) (EGFR, Amgen); Zalutumumab (HuMaxEGFr) (EGFR, Genmab); CDX-110 (EGFRvIII, AVANT Immunotherapeutics); adecatumumab (MT201) (Epcam, Merck); edrecolomab (Panorex, 17-1A) (Epcam, Glaxo/Centocor); MORAb-003 (folate receptor a, Morphotech); KW-2871 (ganglioside GD3, Kyowa); MORAb-009 (GP-9, Morphotech); CDX-1307 (MDX-1307) (hCGb, Celldex); Trastuzumab (Herceptin) (HER2, Celldex); Pertuzumab (rhuMAb 2C4) (HER2 (DI), Genentech); apolizumab (HLA-DR beta chain, PDL Pharma); AMG-479 (IGF-1R, Amgen); anti-IGF-1R R1507 (IGF1-R, Roche); CP 751871 (IGF-R, Pfizer); IMC-A12 (IGF1-R, Imclone); BIIB022 (IGF-1R, Biogen); Mik-beta-1 (IL-2Rb (CD122), Hoffman LaRoche); CNTO 328 (IL6, Centocor); Anti-KIR (1-7F9) (Killer cell Ig-like Receptor (KIR), Novo); Hu3S193 (Lewis (y), Wyeth, Ludwig Institute of Cancer Research); hCBE-11 (LTBR, Biogen); HuHMFG1 (MUC1, Antisoma/NCI); RAV12 (N-linked carbohydrate epitope, Raven); CAL (parathyroid hormone-related protein (PTH-rP), University of California); CT-011 (PD1, CureTech); MDX-1106 (ono-4538) (PD1, Medarex/Ono); MAb CT-011 (PD1, Curetech); IMC-3G3 (PDGFRa, Imclone); bavituximab (phosphatidylserine, Peregrine); huJ591 (PSMA, Cornell Research Foundation); muJ591 (PSMA, Cornell Research Foundation); GC1008 (TGFb (pan) inhibitor (IgG4), Genzyme); Infliximab (Remicade) (TNF.alpha., Centocor); A27.15 (transferrin receptor, Salk Institute, INSERN WO 2005/111082); E2.3 (transferrin receptor, Salk Institute); Bevacizumab (Avastin) (VEGF, Genentech); HuMV833 (VEGF, Tsukuba Research Lab) PCT Publication No. WO/2000/034337, University of Texas); IMC-18F1 (VEGFR1, Imclone); IMC-1121 (VEGFR2, Imclone).

a) Anti-CD3 Binding Moiety

In certain embodiments, the first antigen-binding moiety or the second antigen-binding moiety is an anti-CD3 binding moiety derived from an anti-CD3 antibody comprising 1, 2, or 3 heavy chain CDR sequences selected from the group consisting of: SEQ ID NOs: 342-344 and/or 1, 2, or 3 light chain CDR sequences selected from SEQ ID NOs: 345-347.

These CDR sequences are derived from the anti-CD3 antibody shown in Table A below. The CDR sequences of the WBP3311_2.306.4 antibody are provided below.

TABLE A

| Antibody ID: | | CDR1 | CDR2 | CDR3 |
|---|---|---|---|---|
| WBP3311_2.306.4 | VH | SEQ ID NO: 342<br>GFAFTDYYIH | SEQ ID NO: 343<br>WISPGNVNTKY<br>NENFKG | SEQ ID NO: 344<br>DGYSLYYFDY |
| WBP3311_2.306.4 | VL | SEQ ID NO: 345<br>KSSQSLLNSRTRKN<br>YLA | SEQ ID NO: 346<br>WASTRQS | SEQ ID NO: 347<br>TQSHTLRT |

Heavy and kappa light chain variable region sequences of the WBP3311_2.306.4 antibody are provided below.

WBP3311_2.306.4-VH

Amino acid sequence (SEQ ID NO: 348):
QVQLQQSGPELVKPGASVRISCKAS<u>GFAFTDYYIH</u>WVKQRPGQGLEWIG<u>W
ISPGNVNTKYNENFKG</u>RATLTADLSSSTAYMQLSSLTSEDSAVYFCARD<u>G
YSLYYFDY</u>WGQGTTLTVSS Nucleic acid sequence (SEQ ID NO: 349):
CAGGTCCAGCTGCAGCAGTCTGGACCTGAATTGGTGAAGCCTGGGGCTTC

CGTGAGGATATCCTGCAAGGCTTCTGGCTTCGCCTTCACAGACTACTATA

TACACTGGGTGAAGCAGAGGCCTGGACAGGGTCTTGAGTGGATTGGATGG

ATTTCTCCTGGAAATGTTAATACTAAATACAATGAAAACTTCAAGGGCAG

GGCCACACTGACTGCAGACCTATCCTCCAGCACAGCCTACATGCAGCTCA

GCAGCCTGACCTCTGAGGACTCTGCGGTCTATTTCTGTGCAAGAGATGGA

TATTCCCTGTATTACTTTGACTACTGGGGCCAAGGCACCACTCTCACAGT

CTCCTCA

WBP3311_2.306.4-VL

Amino acid sequence (SEQ ID NO: 350):
DIVMSQSPSSLTVSAGEKVTMSC<u>KSSQSLLNSRTRKNYLA</u>WYQQKPGQSP KWY<u>WASTRQS</u>GVPDRFTGSGSGTAFTLTISGVQAEDLAVYFCT<u>QSHTLRT</u>

FGGGTKLEIK

Nucleic acid sequence (SEQ ID NO: 351):
GACATTGTGATGTCACAGTCTCCATCCTCCCTGACTGTGTCAGCAGGAGA

GAAGGTCACTATGAGCTGCAAATCCAGTCAGAGTCTGCTCAACAGTAGAA

CCCGAAAGAACTACTTGGCTTGGTACCAGCAGAAGCCAGGGCAGTCTCCT

AAACTACTAATCTACTGGGCATCCACTAGGCAATCTGGGGTCCCTGATCG

CTTCACAGGCAGTGGATCTGGGACAGCTTTCACTCTCACCATCAGCGGTG

TGCAGGCTGAAGACCTGGCAGTTTATTTCTGCACGCAATCTCATACTCTT

CGGACGTTCGGTGGAGGCACCAAGCTGGAAATCAAA

CDRs are known to be responsible for antigen binding, however, it has been found that not all of the 6 CDRs are indispensable or unchangeable. In other words, it is possible to replace or change or modify one or more CDRs in the anti-CD3 binding moiety derived from WBP3311_2.306.4, yet substantially retain the specific binding affinity to CD3.

In certain embodiments, the anti-CD3 binding moiety provided herein comprises a heavy chain CDR3 sequence of one of the anti-CD3 antibodies WBP3311_2.306.4. In certain embodiments, the anti-CD3 binding moiety provided herein comprises a heavy chain CDR3 comprising SEQ ID NO: 344. Heavy chain CDR3 regions are located at the center of the antigen-binding site, and therefore are believed to make the most contact with antigen and provide the most free energy to the affinity of antibody to antigen. It is also believed that the heavy chain CDR3 is by far the most diverse CDR of the antigen-binding site in terms of length, amino acid composition and conformation by multiple diversification mechanisms (Tonegawa S., Nature. 302:575-81 (1983)). The diversity in the heavy chain CDR3 is sufficient to produce most antibody specificities (Xu J L, Davis M M., Immunity. 13:37-45 (2000)) as well as desirable antigen-binding affinity (Schier R, et al., J Mol Biol. 263:551-67 (1996)).

In certain embodiments, the anti-CD3 binding moiety provided herein comprises suitable framework region (FR) sequences, as long as the anti-CD3 binding moiety can specifically bind to CD3. The CDR sequences provided in Table A are obtained from mouse antibodies, but they can be grafted to any suitable FR sequences of any suitable species such as mouse, human, rat, rabbit, among others, using suitable methods known in the art such as recombinant techniques.

In certain embodiments, the anti-CD3 binding moiety provided herein is humanized.

In certain embodiments, the humanized antigen binding moiety provided herein is composed of substantially all human sequences except for the CDR sequences which are non-human. In some embodiments, the variable region FRs, and constant regions if present, are entirely or substantially from human immunoglobulin sequences. The human FR sequences and human constant region sequences may be derived different human immunoglobulin genes, for example, FR sequences derived from one human antibody and constant region from another human antibody. In some embodiments, the humanized antigen binding moiety comprises human FR1-4.

The heavy chain and light chain variable region sequences of the anti-CD3 humanized antibody WBP3311_2.306.4-z1 are provided below.

WBP3311_2.306.4-z1-VH

Amino acid sequence (SEQ ID NO: 352):
QVQLVQSGAEVKKPGSSVKVSCKAS<u>GFAFTDYYIH</u>WVRQAPGQGLEWMG<u>W</u>

<u>ISPGNVNTKYNENFKG</u>RVTITADKSTSTAYMELSSLRSEDTAVYYCAR<u>DG</u>

<u>YSLYYFDY</u>WGQGTLVTVSS

Nucleic acid sequence (SEQ ID NO: 353):
CAGGTGCAGCTTGTGCAGTCTGGGGCAGAAGTGAAGAAGCCTGGGTCTAG

TGTCAAGGTGTCATGCAAGGCTAGCGGGTTCGCCTTTACTGACTACTACA

TCCACTGGGTGCGGCAGGCTCCCGGACAAGGGTTGGAGTGGATGGGATGG

ATCTCCCCAGGCAATGTCAACACAAAGTACAACGAGAACTTCAAAGGCCG

CGTCACCATTACCGCCGACAAGAGCACCTCCACAGCCTACATGGAGCTGT

CCAGCCTCAGAAGCGAGGACACTGCCGTCTACTACTGTGCCAGGGATGGG

TACTCCCTGTATTACTTTGATTACTGGGGCCAGGGCACACTGGTGACAGT

GAGCTCC

WBP3311_2.306.4-z1-VL

Amino acid sequence (SEQ ID NO: 354):
DIVMTQSPDSLAVS<u>LGERATINC</u><u>KSSQSLLNSRTKNYLA</u>WYQQKPGQPP KLLIY<u>WASTRQS</u>GVPDRFSGSGSGTDFTLTIS<u>SLQAEDVAVYYC</u><u>TQSHTL</u>

<u>RT</u>FGGGTKVEIK

Nucleic acid sequence (SEQ ID NO: 355):
GATATCGTGATGACCCAGAGCCCAGACTCCCTTGCTGTCTCCCTCGGCGA

AAGAGCAACCATCAACTGCAAGAGCTCCCAAAGCCTGCTGAACTCCAGGA

CCAGGAAGAATTACCTGGCCTGGTATCAGCAGAAGCCCGGCCAGCCTCCT

AAGCTGCTCATCTACTGGGCCTCCACCCGGCAGTCTGGGGTGCCCGATCG

GTTTAGTGGATCTGGGAGCGGGACAGACTTCACATTGACAATTAGCTCAC

TGCAGGCCGAGGACGTGGCCGTCTACTACTGTACTCAGAGCCACACTCTC

CGCACATTCGGCGGAGGGACTAAAGTGGAGATTAAG b) Anti-CD19 Antibody

In certain embodiments, the first antigen-binding moiety or the second antigen-binding moiety is an anti-CD19 binding moiety derived from an anti-CD19 antibody comprising 1, 2, or 3 heavy chain CDR sequences selected from the group consisting of SEQ ID NOs: 356-359, and/or 1, 2, or 3 kappa light chain CDR sequences selected from the group consisting of: SEQ ID NOs: 360-362.

These CDR sequences are derived from the antibodies shown in Table B below. The CDR sequences of these anti-CD19 antibodies are provided below.

TABLE B

| | | CDR1 | CDR2 | CDR3 |
|---|---|---|---|---|
| WBP7011_4.155.8 | VH | SEQ ID NO: 356<br>GYAFTSYNMY | SEQ ID NO: 357<br>YIDPYNGDTTYN<br>QKFKG | SEQ ID NO: 358<br>TAYAMDY |
| W7011-4.155.8-z1-P15 | VH | SEQ ID NO: 356<br>GYAFTSYNMY | SEQ ID NO: 359<br>YIDPYNADTTYN<br>QKFKG | SEQ ID NO: 358<br>TAYAMDY |
| WBP7011_4.155.8 | VL | SEQ ID NO: 360<br>SASSTVNYMH | SEQ ID NO: 361<br>STSNLAS | SEQ ID NO: 362<br>HQWSSYPYT |
| W7011-4.155.8-z1-P15 | VL | SEQ ID NO: 360<br>SASSTVNYMH | SEQ ID NO: 361<br>STSNLAS | SEQ ID NO: 362<br>HQWSSYPYT |

Heavy and kappa light chain variable region sequences of the WBP7011_4.155.8 antibody are provided below.

WBP7011-4.155.8-VH

Amino acid sequence (SEQ ID NO: 363):
EIQLQQSGPELVKPGASVKVSCKAS<u>GYAFTSYNMY</u>WVKQSHGKSLEWIG<u>Y</u>

<u>IDPYNGDTTYNQKFKG</u>KATLTVDKSSSTAYMHLNSLTSEDSAVYYCLT<u>TA</u>

<u>YAMDY</u>WGQGTSVTVSS

-continued

Nucleic acid sequence (SEQ ID NO: 364):
GAGATCCAGCTGCAGCAGTCTGGACCTGAGCTGGTGAAGCCTGGGGCTTC

AGTGAAGGTATCCTGCAAGGCTTCTGGTTATGCATTCACTAGCTACAACA

TGTACTGGGTGAAGCAGAGCCATGGAAAGAGCCTTGAGTGGATTGGATAT

ATTGATCCTTACAATGGTGATACTACCTACAACCAGAAGTTCAAGGGCAA

GGCCACATTGACTGTTGACAAGTCCTCCAGCACAGCCTACATGCATCTCA

ACAGCCTGACATCTGAGGACTCTGCAGTCTATTACTGTCTCACTACGGCC

TATGCTATGGACTACTGGGGTCAAGGAACCTCAGTCACCGTCTCCTCA

WBP7011-4.155.8-VL

Amino acid sequence (SEQ ID NO: 365):
QIVLTQSPAIMSASLGEEITLTC<u>SASSTVNYMH</u>WYQQKSGTSPKLLIY<u>ST</u>

<u>SNLAS</u>GVPSRFSGSGSGTFYSLTIRSVEAEDAADYYC<u>HQWSSYPYT</u>FGGG

TKLEIK

Nucleic acid sequence (SEQ ID NO: 366):
CAAATTGTTCTCACCCAGTCTCCAGCAATCATGTCTGCATCTCTAGGGGA

GGAGATCACCCTAACCTGCAGTGCCAGCTCGACTGTAAATTACATGCACT

GGTACCAGCAGAAGTCAGGCACTTCTCCCAAACTCTTGATTTATAGCACA

TCCAACCTGGCTTCTGGAGTCCCTTCTCGCTTCAGTGGCAGTGGGTCTGG

GACCTTTTATTCTCTCACAATCAGAAGTGTGGAGGCTGAAGATGCTGCCG

ATTATTACTGCCATCAGTGGAGTAGTTATCCGTACACGTTCGGAGGGGGG

ACCAAGCTGGAAATAAAA

In certain embodiments, the anti-CD19 binding moiety disclosed herein comprises a heavy chain CDR3 sequence of the anti-CD19 antibody WBP7011_4.155.8 or W7011-4.155.8-z1-P15. In certain embodiments, the anti-CD19 binding moiety provided herein comprises a heavy chain CDR3 sequence comprising SEQ ID NO: 358. Heavy chain CDR3 regions are located at the center of the antigen-binding site, and therefore are believed to make the most contact with antigen and provide the most free energy to the affinity of antibody to antigen. It is also believed that the heavy chain CDR3 is by far the most diverse CDR of the antigen-binding site in terms of length, amino acid composition and conformation by multiple diversification mechanisms (Tonegawa S., Nature. 302:575-81 (1983)). The diversity in the heavy chain CDR3 is sufficient to produce most antibody specificities (Xu J L, Davis M M. Immunity. 13:37-45 (2000)) as well as desirable antigen-binding affinity (Schier R, etc., J Mol Biol. 263:551-67 (1996)).

In certain embodiments, the anti-CD19 antibodies disclosed herein are humanized. The heavy chain and light chain variable region sequences for the anti-CD19 humanized antibody W7011-4.155.8-z1-P15 are provided below.

W7011-4.155.8-z1-P15-VH

Amino acid sequence (SEQ ID NO: 367):
QMQLVQSGPEVKKPGTSVKVSCKAS<u>GYAFTSYNMY</u>WVRQARGQRLEWIG<u>Y</u>

<u>IDPYNADTTYNQKFK</u>GRVTITRDMSTSTAYMELSSLRSEDTAVYYCLT<u>TA</u>

<u>YAMDY</u>WGQGTLVTVSS

Nucleic acid sequence (SEQ ID NO: 368):
CAAATGCAGCTCGTCCAGTCTGGACCTGAAGTGAAGAAGCCCGGGACATC

CGTCAAGGTCTCATGTAAGGCTAGCGGGTACGCATTCACTTCCTACAACA

TGTACTGGGTGCGCCAGGCCAGAGGACAGAGGTTGGAGTGGATCGGCTAC

ATCGACCCATACAACGCCGATACTACCTACAATCAGAAGTTTAAAGGGCG

GGTGACCATTACCCGGGATATGTCCACCTCCACCGCCTACATGGAGCTGA

GCAGCCTGAGGAGCGAGGACACAGCCGTGTACTACTGCCTGACAACAGCC

TATGCCATGGACTATTGGGGCCAGGGCACACTTGTGACTGTGAGCAGT

W7011-4.155.8-z1-P15-VL

Amino acid sequence (SEQ ID NO: 369):
DIQLTQSPSFLSASVGDRVTITC<u>SASSTVNYMH</u>WYQQKPGKAPKLLIY<u>ST</u>

<u>SNLAS</u>GVPSRFSGSGSGTEFTLTISSLQPEDFATYYC<u>HQWSSYPYT</u>FGQG

TKLEIK

Nucleic acid sequence (SEQ ID NO: 370):
GACATCCAGCTCACCCAATCCCCTTCTTTCCTCTCCGCAAGTGTCGGAGA

TAGGGTGACTATCACCTGCTCAGCTTCTTCAACCGTGAACTACATGCATT

GGTACCAGCAGAAGCCCGGGAAAGCCCCAAAGCTGCTGATCTACAGCACC

TCCAATCTGGCCAGTGGAGTGCCAAGCCGGTTTAGCGGGAGCGGCTCCGG

CACTGAATTCACTTTGACAATTAGCAGCCTTCAGCCTGAGGACTTTGCCA

CATATTACTGTCACCAGTGGTCCAGCTACCCCTACACATTCGGGCAGGGC

ACAAAGCTGGAGATTAAG

Bispecific Polypeptide Complexes

In one aspect, the present disclosure provides herein a bispecific polypeptide complex. The term "bispecific" as used herein means that, there are two antigen-binding moieties, each of which is capable of specifically binding to a different antigen or a different epitope on the same antigen. The bispecific polypeptide complex provided herein comprises a first antigen-binding moiety comprising a first heavy chain variable domain operably linked to a first TCR constant region (C1) and a first light chain variable domain operably linked to a second TCR constant region (C2), wherein C1 and C2 are capable of forming a dimer comprising at least one non-native and stabilizing interchain bond between C1 and C2. The bispecific polypeptide complex provided herein further comprises a second antigen-binding moiety comprising a second antigen-binding site but does not contain a sequence derived from a TCR constant region.

In certain embodiments, the present disclosure provides a bispecific polypeptide complex, comprising a first antigen-binding moiety associated with a second antigen-binding moiety, wherein:
the first antigen-binding moiety comprising:
a first polypeptide comprising, from N-terminus to C-terminus, a first heavy chain variable domain (VH) of a first antibody operably linked to a first T cell receptor (TCR) constant region (C1), and
a second polypeptide comprising, from N-terminus to C-terminus, a first light chain variable domain (VL) of the first antibody operably linked to a second TCR constant region (C2),
wherein:
C1 and C2 are capable of forming a dimer comprising at least one non-native interchain bond between a first mutated residue comprised in C1 and a second mutated residue comprised in C2, and the non-native interchain bond is capable of stabilizing the dimer, and the first antibody has a first antigenic specificity, a second antigen-binding moiety has a second antigenic specificity which is different from the first antigenic specificity, and the first antigen-binding moiety and the second antigen-binding moiety are less prone to mispair than otherwise would have been if both the first and the second antigen-binding moieties are counterparts of natural Fab.

The bispecific polypeptide complex provided herein is significantly less prone to have mispaired heavy chain and light chain variable domains. Without wishing to be bound by any theory, it is believed that the stabilized TCR constant regions in the first antigen-binding moiety can specifically associate with each other and therefore contribute to the highly specific pairing of the intended VH1 and VL1, while discouraging unwanted mispairings of VH1 or VL1 with other variable regions that do not provide for the intended antigen-binding sites.

The bispecific polypeptide complexes in WuXiBody formats have longer in vivo half life and are relatively easier to manufacture when compared to bispecific polypeptide complexes in other formats.

In certain embodiments, the second antigen-binding moiety of the bispecific polypeptide complex provided herein comprises a second heavy chain variable domain (VH2) and a second light chain variable domain (VL2) of a second antibody. In certain embodiments, at least one of VH2 and VL2 is operably linked to an antibody constant region, or both VH2 and VL2 are operably linked to antibody heavy chain and light chain constant regions respectively. In certain embodiments, the second antigen-binding moiety further comprises an antibody constant CH1 domain operably linked to VH2, and an antibody light chain constant domain operably linked to VL2. For example, the second antigen-binding moiety comprises a Fab.

Where a first, second, third, and fourth variable domains (e.g. VH1, VH2, VL1 and VL2) are expressed in one cell, it is highly desired that VH1 specifically pairs with VL1, and VH2 specifically pairs with VL2, such that the resulting bispecific protein product would have the correct antigen-binding specificities. However, in existing technologies such as hybrid-hybridoma (or quadroma), random pairing of VH1, VH2, VL1 and VL2 occurs and consequently results in generation of up to ten different species, of which only one is the functional bispecific antigen-binding molecule. This not only reduces production yields but also complicates the purification of the target product.

The bispecific polypeptide complexes provided herein are exceptional in that the variable domains are less prone to mispair than otherwise would have been if both the first and the second antigen-binding moieties are counterparts of natural Fab. In an illustrative example, the first antigen-binding domain comprises VH1-C1 paired with VL1-C2, and the second antigen-binding domain comprises VH2-CH1 paired with VL2-CL. It has been surprisingly found that C1 and C2 preferentially associates with each other, and are less prone to associate with CL or CH1, thereby formation of unwanted pairs such as C1-CH, C1-CL, C2-CH, and C2-CL are discouraged and significantly reduced. As a result of specific association of C1-C2, VH1 specifically pairs with VL1 and thereby rendering the first antigen binding site, and CH1 specifically pairs with CL, thereby allowing specific pairing of VH2-VL2 which provides for the second antigen binding site. Accordingly, the first antigen binding moiety and the second antigen binding moiety are less prone to mismatch, and mispairings between for example VH1-VL2, VH2-VL1, VH1-VH2, VL1-VL2 would be significantly reduced otherwise could have been if both the first and the second antigen-binding moieties are counterparts of natural Fabs, e.g. in the form of VH1-CH1, VL1-CL, VH2-CH1, and VL2-CL.

In certain embodiments, the bispecific polypeptide complex provided herein, when expressed from a cell, would have significantly less mispairing products (e.g., at least 1, 2, 3, 4, 5 or more mispairing products less) and/or significantly higher production yield (e.g., at least 10%, 20%, 30%, 40%, 50%, 60% or more higher yield), than a reference molecule expressed under comparable conditions, wherein the reference molecule is otherwise identical to the bispecific polypeptide complex except having a native CH1 in the place of C1 and a native CL in the place of C2.

In certain embodiments, the first and/or the second antigen binding moiety is multivalent, such as bivalent, trivalent, tetravalent. The term "valent" as used herein refers to the presence of a specified number of antigen binding sites in a given molecule. As such, the terms "bivalent", "tetravalent", and "hexavalent" denote the presence of two binding site, four binding sites, and six binding sites, respectively, in an antigen-binding molecule. A bivalent molecule can be monospecific if the two binding sites are both for specific binding of the same antigen or the same epitope. Similarly, a trivalent molecule can be bispecific, for example, when two binding sites are monospecific for a first antigen (or epitope) and the third binding site is specific for a second antigen (or epitope). In certain embodiments, the first and/or the second antigen-binding moiety in the bispecific polypeptide complex provided herein can be bivalent, trivalent, or tetravalent, with at least two binding sites specific for the same antigen or epitope. This, in certain embodiments, provides for stronger binding to the antigen or the epitope than a monovalent counterpart. In certain embodiments, in a bivalent antigen-binding moiety, the first valent of binding site and the second valent of binding site are structurally identical (i.e. having the same sequences), or structurally different (i.e. having different sequences albeit with the same specificity).

In certain embodiments, the first and/or the second antigen binding moiety is multivalent and comprises two or more antigen binding sites operably linked together, with or without a spacer.

In certain embodiments, the first and/or the second antigen binding moiety comprises one or more Fab, Fab', Fab'-SH, F(ab')$_2$, Fd, Fv, and scFv fragments, and other fragments described in Spiess et al., 2015, supra and Brinkmann et al., 2017, supra, or the combination thereof, which are linked with or without a spacer at the heavy chain and/or the light chain and forms at least one are capable of binding to a second antibody.

In certain embodiments, the second antigen binding moiety comprises two or more Fab of the second antibody. The two Fabs can be operably linked to each other, for example the first Fab can be covalently attached to the second Fab via heavy chain, with or without a spacer in between.

In certain embodiments, the first antigen-binding moiety further comprises a first dimerization domain, and the second antigen-binding moiety further comprises a second dimerization domain. The term "dimerization domain" as used herein refers to the peptide domain which is capable of associating with each other to form a dimer, or in some examples, enables spontaneous dimerization of two peptides.

In certain embodiments, the first dimerization domain can be associated with the second dimerization domain. The association can be via any suitable interaction or linkage or bonding, for example, via a connecter, a disulphide bond, a hydrogen bond, electrostatic interaction, a salt bridge, or hydrophobic-hydrophilic interaction, or the combination thereof. Exemplary dimerization domains include, without limitation, antibody hinge region, an antibody CH2 domain, an antibody CH3 domain, and other suitable protein monomers capable of dimerizing and associating with each other. Hinge region, CH2 and/or CH3 domain can be derived from any antibody isotypes, such as IgG1, IgG2, and IgG4.

In certain embodiments, the first and/or the second dimerization domain comprises at least a portion of an antibody hinge region. In certain embodiments, the first and/or the second dimerization domain may further comprise an antibody CH2 domain, and/or an antibody CH3 domain. In certain embodiments, the first and/or the second dimerization domain comprises at least a portion of Hinge-Fc region, i.e. Hinge-CH2-CH3 domain. In certain embodiments, the first dimerization domain can be operably linked to the C terminal of the first TCR constant region. In certain embodiments, the second dimerization domain can be operably linked to the C terminal of the antibody CH1 constant region of the second antigen-binding moiety.

In certain embodiments, the first dimerization domain is operably linked to (with or without a spacer in between) the first TCR constant region (C1) at a third conjunction domain.

If the Fv region of an immunoglobulin is aligned with a TCR immunoglobulin-like domain, the antibody Hinge N terminal and the TCR Hinge N terminal would also be aligned. An example is given in Table 7 below, where antibody Hinge N terminal (SEQ ID NO: 278 or 279) is aligned to TCR Beta Hinge N terminal (SEQ ID NO: 280).

The third conjunction domain of the bispecific polypeptide complex as provided herein can be selected such that it comprises a proper length (e.g., 0, 1, 2, 3, 4, 5, 6, 7, 8, 9, or 10 amino acid residues) of the antibody Hinge N terminal, and a proper length (e.g., 0, 1, 2, 3, 4, 5, 6, 7, 8, 9, or 10 amino acid residues) of the TCR Hinge N terminal. The term "Hinge N terminal" as used herein refers to the most N terminal fragment of the hinge region. For example, the conjunction domain may be selected to have all, or most, or some sequences from the antibody Hinge N terminal or from the TCR Hinge N terminal, or may comprise more residues from antibody Hinge N terminal than from TCR Hinge N terminal, or vice versa.

In certain embodiments, the third conjunction domains of the polypeptide complex as provided herein have a total length comparable to that of the antibody Hinge N terminal or that of the TCR Hinge N terminal.

Similarly, a proper third conjunction domain can be determined on a structural basis. For example, the three-dimensional structures of antibody and TCR may be superimposed, and overlappings of the antibody Hinge N terminal and the TCR Hinge N terminal on the superimposed structure may be determined and considered when determining the length or proportion of sequences from antibody or TCR Hinge N terminal.

In certain embodiments, the third conjunction domain comprises a spacer in between the fragments from antibody Hinge N terminal and TCR Hinge N terminal. Any suitable sequences or length of spacer sequences can be used, as long as it does not negatively affect the antigen binding or stability of the polypeptide complex.

Exemplary sequences of antibody Hinge N terminal, TCR Hinge N terminal, and the third conjunction domains are provided in the below Tables 7, 8, 9 and 10.

In certain embodiments, C1 comprises an engineered CBeta and the first dimerization domain comprises hinge and Fc of IgG1 or IgG4. Table 7 shows the exemplary designs for the conjunction domains useful for TCR CBeta fused to antibody Hinge. The antibody Hinge N terminal is aligned to TCR Beta Hinge N terminal. Exemplary designs of the conjunction domains are also provided in an alignment form (see, e.g., SEQ ID NO: 152 or 153). In such embodiments, the third conjunction domain is comprised in SEQ ID NO: 53 or 54 (which encompass the third conjunction domain and the Hinge C terminal).

TABLE 7

Third conjunction domain designs for VH-CBeta-Hinge

| | Hinge | SEQ ID NO |
|---|---|---|
| IgG1_Antibody_H | EPKS-CDKTHTC...... | 278 |
| IgG4_Antibody_H | ESK----YGPPC...... | 279 |
| TCR_beta | WGRADCGFTSVS...... | 280 |
| Conjunction'_1 (IgG1) | WGRA-SDKTHTC...... | 152 |
| Conjunction'_1 (IgG4) | WGR----YGPPC...... | 153 |

In certain embodiments, C1 comprises an engineered CAlpha or CPre-Alpha and the first dimerization domain comprises hinge and Fc of IgG1 or IgG4. Table 8 shows the exemplary designs for the conjunction domains useful for TCR CAlpha or CPre-Alpha fused to antibody Hinge. The antibody Hinge N terminal is aligned to TCR Alpha or CPre-Alpha Hinge N terminal. In such embodiments, the third conjunction domain is comprised in SEQ ID NO: 134, 135, 140, or 141 (which encompass the third conjunction domain and the Hinge C terminal).

TABLE 8

Third conjunction domain designs for VH-CAlpha-Hinge

| | Hinge | SEQ ID NO |
|---|---|---|
| IgG1_Antibody_H | EPKS-CDKTHTC...... | 281 |
| IgG4_Antibody_H | ESK----YGPPC...... | 282 |
| TCR_alpha or TCR_pre-alpha | ------------ | |
| Conjunction'_2 (IgG1) | -----SDKTHTC...... | 154 |
| Conjunction'_2 (IgG4) | -------YGPPC...... | 155 |

In certain embodiments, C1 comprises an engineered CGamma and the first dimerization domain comprises hinge and Fc of IgG1 or IgG4. Table 9 shows the exemplary designs for the conjunction domains useful for TCR CGamma fused to antibody Hinge. The antibody Hinge N terminal is aligned to TCR Gamma Hinge N terminal.

Exemplary designs of the conjunction domains are also provided in an alignment form (see, e.g., SEQ ID NO: 165 or 166). In such embodiments, the third conjunction domain is comprised in SEQ ID NO: 121 or 122 (which encompass the third conjunction domain and the Hinge C terminal).

TABLE 9

Third conjunction domain designs for VH-CGamma-Hinge

|  | Hinge | SEQ ID NO |
|---|---|---|
| IgG1_Antibody_H | EPKSCDKTHTC...... | 60 |
| IgG4_Antibody_H | ESK---YGPPC...... | 61 |
| TCR_gamma | PPIKTDVITMD...... | 62 |
| Conjunction'_3 (IgG1) | PPIKSDKTHTC...... | 165 |
| Conjunction'_3 (IgG4) | PPI---YGPPC...... | 166 |

In certain embodiments, C1 comprises an engineered CDelta and the first dimerization domain comprises hinge and Fc of IgG1 or IgG4. Table 10 shows the exemplary designs for the conjunction domains useful for TCR CDelta fused to antibody Hinge. The antibody Hinge N terminal is aligned to TCR Delta Hinge N terminal. Exemplary designs of the conjunction domains are also provided in an alignment form. In such embodiments, the third conjunction domain is comprised in SEQ ID NO: 127, or 128 (which encompass the third conjunction domain and the Hinge C terminal).

TABLE 10

Third conjunction domain designs for VH-CDelta-Hinge-Fc

|  | Hinge and Fc | SEQ ID NO |
|---|---|---|
| IgG1_Antibody_H | EPKSCDKTHTC...... | 63 |
| IgG4_Antibody_H | ESK---YGPPC...... | 103 |
| TCR_delta | FEVKTDSTDHV...... | 104 |
| Conjunction'_4 (IgG1) | EPKSSDKTHTC...... | 167 |
| Conjunction'_4 (IgG4) | ESK---YGPPC...... | 168 |

In certain embodiments, the first dimerization domain is operably linked to the C-terminal of an engineered TCR constant region, and together forms a chimeric constant region. In other words, the chimeric constant region comprises the first dimerization domain operably linked with the engineered TCR constant region.

In certain embodiments, the chimeric constant region comprises an engineered CBeta attached to the first hinge-Fc region derived from IgG1, IgG2 or IgG4. Exemplary sequences of such a chimeric constant region are provided in Tables 11, 12, 13 and 14.

In certain embodiments, the chimeric constant region comprises an engineered CAlpha attached to the first hinge derived from IgG1, IgG2 or IgG4. Exemplary sequences of such chimeric constant region are provided in Tables 11, 12, and 13.

In certain embodiments, the chimeric constant region comprises an engineered CPre-Alpha attached to the first hinge derived from IgG1, IgG2 or IgG4, at the third conjunction domain comprising or being SEQ ID NO: 134, 135, 140 or 141. Exemplary sequences of such a chimeric constant region are provided in Tables 15 and 16.

In certain embodiments, the chimeric constant region comprises an engineered CGamma attached to the first hinge derived from IgG1, IgG2 or IgG4. Exemplary sequences of such a chimeric constant region are provided in Tables 17, 18.

In certain embodiments, the chimeric constant region comprises an engineered CDelta attached to the first hinge derived from IgG1, IgG2 or IgG4. Exemplary sequences of such a chimeric constant region are provided in Tables 17 and 18.

In certain embodiments, the chimeric constant region further comprises a first antibody CH2 domain, and/or a first antibody CH3 domain. For example, the chimeric constant region further comprises a first antibody CH2-CH3 domain attached to the C-terminus of the third conjunction domain. Exemplary sequences of such chimeric constant region are provided in Table 19.

In certain embodiments, the first chimeric constant region and the second TCR constant domain comprises a pair of sequences selected from the group consisting of SEQ ID NOs: 177/176, 179/178, 184/183, 185/183, 180/176, 181/178, 182/178, 184/186, 185/186, 188/187, 196/187, 190/189, 192/191, 192/193, 195/194, 198/197, 200/199, 202/201, 203/201, 203/204, 205/204, 206/204, 208/207, 208/209, 211/210, 213/212, 213/151, 214/212, 214/151, 234/233, 232/231, 216/215, 218/217, 220/219, 222/221, 224/223, 226/225, 227/223, 229/228, 229/230, 236/235 and 238/237, as shown in Table 19.

These pairs of chimeric constant regions and second TCR constant domains are useful in that they can be manipulated to fuse to a desired antibody variable region, so as to provide for the polypeptide complex as disclosed herein. For example, an antibody heavy chain variable region can be fused to the chimeric constant region (comprising C1), thereby rendering the first polypeptide chain of the polypeptide complex provided herein; and similarly, an antibody light chain variable region can be fused to the second TCR constant domain (comprising C2), thereby rendering the second polypeptide chain of the polypeptide complex provided herein.

These pairs of chimeric constant regions and second TCR constant domains can be used as a platform for generating the first antigen-binding moiety of the bispecific polypeptide complexes provided herein. For example, variable regions of a first antibody can be fused at the N-terminus of the platform sequences (e.g. fusing the VH to the chimeric constant domain and the VL to the TCR constant domain, respectively). To produce the bispecific polypeptide complex, the second antigen-binding moiety can be designed and produced, so as to associate into the bispecific polypeptide complex provided herein.

In certain embodiments, the second dimerization domain comprises a hinge region. The hinge region may be derived from an antibody, such as IgG1, IgG2, or IgG4. In certain embodiments, the second dimerization domain may optionally further comprise an antibody CH2 domain, and/or an antibody CH3 domain, for example such as a hinge-Fc region. The hinge region may be attached to the antibody heavy chain of the second antigen binding site (e.g. Fab).

In the bispecific polypeptide complex, the first and the second dimerization domain are capable of associating into a dimer. In certain embodiments, the first and the second dimerization domains are different and associate in a way that discourages homodimerization and/or favors heterodimerization. For example, the first and the second dimerization domains can be selected so that they are not identical and that they preferentially form heterodimers between each other rather than to form homodimers within themselves. In certain embodiments, the first and the second dimerization domains are capable of associating into heterodimers via formation of knob-into-hole, hydrophobic interaction, electrostatic interaction, hydrophilic interaction, or increased flexibility.

In certain embodiments, the first and the second dimerization domains comprise CH2 and/or CH3 domains which are respectively mutated to be capable of forming a knobs-into-holes. A knob can be obtained by replacement of a small amino acid residue with a larger one in the first CH2/CH3 polypeptide, and a hole can be obtained by replacement of a large residue with a smaller one. For details of the mutation sites for knobs into holes please see Ridgway et al., 1996, supra, Spiess et al., 2015, supra and Brinkmann et al., 2017, supra.

In certain embodiments, the first and the second dimerization domains comprise a first CH3 domain of the IgG1 isotype containing S139C and T151W substitution (SEQ ID NO: 295, knob) and a second CH3 domain of the IgG1 isotype containing Y134C, T151S, L153A and Y192V substitution (SEQ ID NO: 296, hole). In another embodiments, the first and the second dimerization domains comprise a first CH3 domain of the IgG4 isotype containing S136C and T148W substitution (SEQ ID NO: 298, knob) and a second CH3 domain of the IgG4 isotype containing Y131C, T148S, L150A and Y189V substitution (SEQ ID NO: 299, hole). The sequences and numberings of wild type Fc IgG1 (SEQ ID NO: 294) and Fc IgG4 (SEQ ID NO: 297) are shown in FIGS. 20A-20D. As noted above, XnY when referring to Fc region (e.g. CH3 domain of the Fc region), the numbering of the amino acid residue is based on the numbering shown in FIGS. 20A-20D.

In certain embodiments, the first and the second dimerization domains further comprise a first hinge region and a second hinge region. For example, charge pairs of substitution can be introduced into the hinge region of IgG1 and IgG2 to promote heterodimerization. For details see Brinkmann et al., 2017, supra.

Bispecific Format

The bispecific polypeptide complex provided herein can be in any suitable bispecific format known in the art. In certain embodiments, the bispecific polypeptide complex is based on a reference bispecific antibody format. "Based on" as used herein with respect to a bispecific format means that the bispecific polypeptide complex provided herein takes the same bispecific format of a reference bispecific antibody, except that one of the antigen-binding moiety has been modified to comprise a VH operably linked to C1 and a VL operably linked to C2 wherein C1 and C2 are associated with at least one non-native interchain bond, as defined above. Examples of reference bispecific antibody formats known in the art include, without limitation, (i) a bispecific antibody with symmetric Fc, (ii) a bispecific antibody with asymmetric Fc, (iii) a regular antibody appended with an additional antigen-binding moiety, (iv) a bispecific antibody fragment, (v) a regular antibody fragment appended with an additional antigen-binding moiety, (vi) a bispecific antibody appended with human albumin or human albumin-binding peptide.

BsIgG is monovalent for each antigen and can be produced by co-expression of the two light and two heavy chains in a single host cell. An appending IgG is engineered to form bispecific IgG by appending either the amino or carboxy termini of either light or heavy chains with additional antigen-binding units. The additional antigen-binding units can be single domain antibodies (unpaired VL or VH), such as DVD-Ig, paired antibody variable domains (e.g. Fv or scFv) or engineered protein scaffolds. Any of the antigen-binding units in BsIgG, in particular paired VH-CH1/VL-CL, can be modified to replace the CH1 to C1 and CL to C2 as disclosed herein, to render the bispecific polypeptide complex as provided herein.

Bispecific antibody fragments are antigen-binding fragments that are derived from an antibody but lack some or all of the antibody constant domains. Examples of such a bispecific antibody fragment include, for example, such as single domain antibody, Fv, Fab and diabody etc. To render the bispecific polypeptide complex as provided herein, an antigen-binding site (e.g. particular paired VH-CH1/VL-CL) in a bispecific antibody fragment, can be modified to comprise the polypeptide complex as disclosed herein (e.g. VH-C1/CL-C2).

In certain embodiments, the bispecific polypeptide complex as provided herein is based on the format of a "whole" antibody, such as whole IgG or IgG-like molecules, and small recombinant formats, such as tandem single chain variable fragment molecules (taFvs), diabodies (Dbs), single chain diabodies (scDbs) and various other derivatives of these (cf. bispecific antibody formats as described by Byrne H. et al. (2013) Trends Biotech, 31 (11): 621-632. Examples of bispecific antibody is based on a format which include, but is not limited to, quadroma, chemically coupled Fab (fragment antigen binding), and BiTE (bispecific T cell engager).

In certain embodiments, the bispecific polypeptide complex as provided herein is based on a bispecific format selected from Triomabs; hybrid hybridoma (quadroma); Multispecific anticalin platform (Pieris); Diabodies; Single chain diabodies; Tandem single chain Fv fragments; Tand-Abs, Trispecific Abs (Affimed); Darts (dual affinity retargeting; Macrogenics); Bispecific Xmabs (Xencor); Bispecific T cell engagers (Bites; Amgen; 55 kDa); Triplebodies; Tribody (Fab-scFv) Fusion Protein (CreativeBiolabs) multifunctional recombinant antibody derivates; Duobody platform (Genmab); Dock and lock platform; Knob into hole (KIH) platform; Humanized bispecific IgG antibody (REGN1979) (Regeneron); $Mab_2$ bispecific antibodies (F-Star); DVD-Ig (dual variable domain immunoglobulin) (Abbvie); kappa-lambda bodies; TBTI (tetravalent bispecific tandem Ig); and CrossMab.

In certain embodiments, the bispecific polypeptide complex as provided herein is based on a bispecific format selected from bispecific IgG-like antibodies (BsIgG) comprising CrossMab; DAF (two-in-one); DAF (four-in-one); DutaMab; DT-IgG; Knobs-in-holes common LC; Knobs-in-holes assembly; Charge pair; Fab-arm exchange; SEED-body; Triomab; LUZ-Y; Fcab; kappa-lamda-body; and Orthogonal Fab. For detailed description of the bispecific antibody formats please see Spiess C., Zhai Q. and Carter P. J. (2015) Molecular Immunology 67: 95-106, which is incorporated herein by reference in its entirety.

In certain embodiments, the bispecific polypeptide complex as provided herein is based on a bispecific format selected from IgG-appended antibodies with an additional antigen-binding moiety comprising DVD-IgG; IgG(H)-scFv; scFv-(H)IgG; IgG(L)-scFv; scFV-(L)IgG; IgG(L,H)-

Fv; IgG(H)-V; V(H)-IgG; IgG(L)-V; V(L)-IgG; KIH IgG-scFab; 2scFv-IgG; IgG-2scFv; scFv4-Ig; scFv4-Ig; Zybody; and DVI-IgG (four-in-one) (see Id.).

In certain embodiments, the bispecific polypeptide complex as provided herein is based on a format selected from bispecific antibody fragments comprising Nanobody; Nanobody-HAS; BiTE; Diabody; DART; TandAb; scDiabody; sc-Diabody-CH3; Diabody-CH3; Triple Body; Miniantibody; Minibody; TriBi minibody; scFv-CH3 KIH; Fab-scFv; scFv-CH-CL-scFv; F(ab')2; F(ab')2-scFv2; scFv-KIH; Fab-scFv-Fc; Tetravalent HCAb; scDiabody-Fc; Diabody-Fc; Tandem scFv-Fc; and Intrabody (see Id.).

In certain embodiments, the bispecific polypeptide complex as provided herein is based on a bispecific format such as Dock and Lock; ImmTAC; HSAbody; scDiabody-HAS; and Tandem scFv-Toxin (see Id.).

In certain embodiments, the bispecific polypeptide complex as provided herein is based on a format selected from bispecific antibody conjugates comprising IgG-IgG; Cov-X-Body; and scFv1-PEG-scFv2 (see Id.).

In certain embodiments, the first antigen-binding moiety and the second binding moiety can be associated into an Ig-like structure. An Ig-like structure is like a natural antibody having a Y shaped construct, with two arms for antigen-binding and one stem for association and stabilization. The resemblance to natural antibody can provide for various advantages such as good in vivo pharmakinetics, desired immunological response and stability etc. It has been found that the Ig-like structure comprising the first antigen-binding moiety provided herein associated with the second antigen-binding moiety provided herein has thermal stability which is comparable to that of an Ig (e.g. an IgG). In certain embodiments, the Ig-like structure provided herein is at least 70%, 80%, 90%, 95% or 100% of that of a natural IgG.

In certain embodiments, the bispecific polypeptide complex comprises four polypeptide chains: i) VH1-C1-Hinge-CH2-CH3; ii) VL1-C2; iii) VH2-CH1-Hinge-CH2-CH3, and iv) VL2-CL, wherein the C1 and C2 are capable of forming a dimer comprising at least one non-native interchain bond, and the two hinge regions and/or the two CH3 domains are capable of forming one or more interchain bond that can facilitate dimerization.

Antigenic Specificities of the Bispecific Complex

The bispecific complex provided herein have two antigenic specificities. The first and the second antigen-binding moieties are directed to the first and the second antigenic specificities respectively.

The first and the second antigenic specificities may be identical, in other words, the first and the second antigen-binding moieties binds to the same antigen molecule, or to the same epitope of the same antigen molecule.

Alternatively, the first and the second antigenic specificities may be distinct. For example, the first and the second antigen-binding moieties can bind to different antigens. Such a bispecific polypeptide complex could be useful in, for example, bringing the two different antigens into close proximity and thereby promoting their interactions (e.g. bringing immunological cells in close proximity to a tumor antigen or a pathogen antigen and hence promoting recognition or elimination of such an antigen by the immune system). For another example, the first and the second antigen-binding moieties can bind to different (and optionally non-overlapping) epitopes of one antigen. This may be helpful in enhancing the recognition of or binding to a target antigen, in particular one which is susceptible to mutation (e.g. a viral antigen).

In some embodiments, one of the antigenic specificity of the bispecific complex provided herein is directed to a T-cell specific receptor molecule and/or a natural killer cell (NK cell) specific receptor molecule. In some embodiments, one of the first and second antigen-binding moiety is capable of specifically binding to CD3, TCR, CD28, CD16, NKG2D, Ox40, 4-1BB, CD2, CD5 or CD95, and the other is capable of specifically binding to a tumor associated antigen.

In certain embodiments, one of the antigenic specificity of the bispecific complex provided herein is directed to CD3. In certain embodiments, the first antigen-binding moiety of the bispecific complex is capable of specifically binding to CD3. In certain embodiments, the second antigen-binding moiety of the bispecific complex is capable of specifically binding to CD3.

In certain embodiments, the antigen-binding moiety of the bispecific complex comprises a VH1 and a VL1 both derived from an anti-CD3 antibody. In certain embodiments, the polypeptide complex or the bispecific polypeptide complex provided herein, wherein the first polypeptide and the second polypeptide comprise a pair of sequences selected from the group consisting of SEQ ID NOs: 2/1, 3/4/, 5/1, 6/3, 7/3, 9/8, 10/8, 9/11, 10/11, 13/12, 15/14, 17/16, 17/18, 20/19, 21/12, 28/3, 29/3, 30/12, 31/12, 65/64, 67/66, 69/68, 70/68, 70/71, 72/71, 73/71, 75/74, 75/76, 78/77, 86/85, 90/89, 91/92/, 94/93, 96/95, 98/97, 99/95, 101/100, 101/102, 106/105, 108/107, 110/109, 112/111, 137/136, 138/136, 137/139 and 138/139, wherein the variable regions of anti-CD3 antibody (T3) are fused to the TCR constant region as shown in Table 20.

In some embodiments, one of the antigenic specificity of the bispecific complex provided herein is directed to a T-cell specific receptor molecule and/or a natural killer cell (NK cell) specific receptor molecule, and the other antigenic specificity is directed to a tumor associated surface antigen. In certain embodiments, the first antigen-binding moiety of the bispecific complex is capable of specifically binding to T-cell specific receptor molecule and/or a natural killer cell (NK cell) specific receptor molecule (such as CD3), and the second antigen-binding moiety is capable of specifically binding to a tumor associated antigen (such as CD19), or vice versa.

In certain embodiments, the bispecific polypeptide complex comprises a four-sequence combination selected from the group consisting of: SEQ ID NOs: 22/12/24/23 (E17, IgG1), 25/12/26/23 (E17, IgG4), and 25/12/27/23 (F16), as shown in Example 8 and Table 20, wherein the first antigen binding moiety binds to CD3, and the second antigen binding moiety binds to CD19. The design of E17 is a bispecific, bivalent antibody, and the design of F16 is a bispecific and trivalent antigen-binding complex, with two repeats of anti-CD19 antibody Fab.

In certain embodiments, the bispecific polypeptide complex comprises a first antigen binding moiety that binds to CTLA-4, and a second antigen binding moiety that binds to PD-1, or vice versa.

In certain embodiments, the bispecific polypeptide complex comprises four polypeptide chains comprising: i) VH1 operably linked to a first chimeric constant region; ii) VL1 operably linked to a second chimeric constant region; iii) VH2 operably linked to conventional antibody heavy chain constant region, and iv) VL2 operably linked to conventional antibody light chain constant region. In certain embodiments, the first chimeric constant region can comprise C1-Hinge-CH2-CH3, each as defined supra. In certain embodiments, the second chimeric constant region can comprise C2, as defined supra. In certain embodiments, the conventional antibody heavy chain constant region can comprise CH1-Hinge-CH2-CH3, each as defined supra. In certain embodiments, the conventional antibody light chain constant region can comprise CL, as defined supra.

The following construct names are used interchangeably in this disclosure: E17-Design_2-QQQQ and W3438-T3U4.E17-1.uIgG4.SP; F16-Design-2-QQQQ and W3438-T3U4.F16-1.uIgG4.SP; U6T5.G25.IgG4 and W3248-U6T5.G25-1.uIgG4.SP; and U6T1.G25R.IgG4 and W3248-U6T1.G25R-1.uIgG4.SP.

Method of Preparation

The present disclosure provides isolated nucleic acids or polynucleotides that encode the polypeptide complex, and the bispecific polypeptide complex provided herein.

The term "nucleic acid" or "polynucleotide" as used herein refers to deoxyribonucleic acids (DNA) or ribonucleic acids (RNA) and polymers thereof in either single- or double-stranded form. Unless specifically limited, the term encompasses polynucleotides containing known analogues of natural nucleotides that have similar binding properties as the reference nucleic acid and are metabolized in a manner similar to naturally occurring nucleotides. Unless otherwise indicated, a particular polynucleotide sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (see Batzer et al., Nucleic Acid Res. 19:5081 (1991); Ohtsuka et al., J. Biol. Chem. 260: 2605-2608 (1985); and Rossolini et al., Mol. Cell. Probes 8:91-98 (1994)).

The nucleic acids or polynucleotides encoding the polypeptide complex and the bispecific polypeptide complex provided herein can be constructed using recombinant techniques. To this end, DNA encoding an antigen-binding moiety of a parent antibody (such as CDR or variable region) can be isolated and sequenced using conventional procedures (e.g., by using oligonucleotide probes that are capable of binding specifically to genes encoding the heavy and light chains of the antibody). Likewise, DNA encoding a TCR constant region can also be obtained. As an example, the polynucleotide sequence encoding the variable domain (VH) and the polynucleotide sequence encoding the first TCR constant region (C1) are obtained and operably linked to allow transcription and expression in a host cell to produce the first polypeptide. Similarly, polynucleotide sequence encoding VL are operably linked to polynucleotide sequence encoding C1, so as to allow expression of the second polypeptide in the host cell. If needed, encoding polynucleotide sequences for one or more spacers are also operably linked to the other encoding sequences to allow expression of the desired product.

The encoding polynucleotide sequences can be further operably linked to one or more regulatory sequences, optionally in an expression vector, such that the expression or production of the first and the second polypeptides is feasible and under proper control.

The encoding polynucleotide sequence(s) can be inserted into a vector for further cloning (amplification of the DNA) or for expression, using recombinant techniques known in the art. In another embodiment, the polypeptide complex and the bispecific polypeptide complex provided herein may be produced by homologous recombination known in the art. Many vectors are available. The vector components generally include, but are not limited to, one or more of the following: a signal sequence, an origin of replication, one or more marker genes, an enhancer element, a promoter (e.g. SV40, CMV, EF-1α), and a transcription termination sequence.

The term "vector" as used herein refers to a vehicle into which a polynucleotide encoding a protein may be operably inserted so as to bring about the expression of that protein. Typically, the construct also includes appropriate regulatory sequences. For example, the polynucleotide molecule can include regulatory sequences located in the 5'-flanking region of the nucleotide sequence encoding the guide RNA and/or the nucleotide sequence encoding a site-directed modifying polypeptide, operably linked to the coding sequences in a manner capable of expressing the desired transcript/gene in a host cell. A vector may be used to transform, transduce, or transfect a host cell so as to bring about expression of the genetic element it carries within the host cell. Examples of vectors include plasmids, phagemids, cosmids, artificial chromosomes such as yeast artificial chromosome (YAC), bacterial artificial chromosome (BAC), or P1-derived artificial chromosome (PAC), bacteriophages such as lambda phage or M13 phage, and animal viruses. Categories of animal viruses used as vectors include retrovirus (including lentivirus), adenovirus, adeno-associated virus, herpesvirus (e.g., herpes simplex virus), poxvirus, baculovirus, papillomavirus, and papovavirus (e.g., SV40). A vector may contain a variety of elements for controlling expression, including promoter sequences, transcription initiation sequences, enhancer sequences, selectable elements, and reporter genes. In addition, the vector may contain an origin of replication. A vector may also include materials to aid in its entry into the cell, including but not limited to a viral particle, a liposome, or a protein coating.

In some embodiments, the vector system includes mammalian, bacterial, yeast systems, etc., and comprises plasmids such as, but not limited to, pALTER, pBAD, pcDNA, pCal, pL, pET, pGEMEX, pGEX, pCI, pCMV, pEGFP, pEGFT, pSV2, pFUSE, pVITRO, pVIVO, pMAL, pMONO, pSELECT, pUNO, pDUO, Psg5L, pBABE, pWPXL, pBI, p15TV-L, pPro18, pTD, pRS420, pLexA, pACT2.2 etc., and other laboratorial and commercially available vectors. Suitable vectors may include, plasmid, or viral vectors (e.g., replication defective retroviruses, adenoviruses and adeno-associated viruses).

Vectors comprising the polynucleotide sequence(s) provided herein can be introduced to a host cell for cloning or gene expression. The phrase "host cell" as used herein refers to a cell into which an exogenous polynucleotide and/or a vector has been introduced.

Suitable host cells for cloning or expressing the DNA in the vectors herein are the prokaryote, yeast, or higher eukaryote cells described above. Suitable prokaryotes for this purpose include eubacteria, such as Gram-negative or Gram-positive organisms, for example, Enterobacteriaceae such as *Escherichia*, e.g., *E. coli, Enterobacter, Erwinia, Klebsiella, Proteus, Salmonella*, e.g., *Salmonella typhimurium, Serratia*, e.g., *Serratia marcescans*, and *Shigella*, as well as Bacilli such as *B. subtilis* and *B. licheniformis, Pseudomonas* such as *P. aeruginosa*, and *Streptomyces*.

In addition to prokaryotes, eukaryotic microbes such as filamentous fungi or yeast are suitable cloning or expression hosts for the vectors encoding the polypeptide complex and the bispecific polypeptide complex. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe; Kluyveromyces* hosts such as, e.g., *K. lactis, K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906), *K. thermotolerans*, and *K. marxianus; yarrowia* (EP 402,226); *Pichia pastoris* (EP 183,070); *Candida; Trichoderma reesia* (EP 244,234); *Neurospora crassa; Schwanniomyces* such as *Schwanniomyces occidentalis*; and filamentous fungi such as, e.g., *Neurospora, Penicillium, Tolypocladium*, and *Aspergillus* hosts such as *A. nidulans* and *A. niger*.

Suitable host cells for the expression of glycosylated polypeptide complex, the bispecific polypeptide complex provided herein are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruitfly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells. Plant cell cultures of cotton, corn, potato, soybean, petunia, tomato, and tobacco can also be utilized as hosts.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)), such as Expi293; baby hamster kidney cells (BHK, ATCC CCL 10); Chinese hamster ovary cells/-DHFR (CHO, Urlaub et al., Proc. Natl. Acad. Sci. USA 77:4216 (1980)); mouse sertoli cells (TM4, Mather, Biol. Reprod. 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., Annals N.Y. Acad. Sci. 383:44-68 (1982)); MRC 5 cells; FS4 cells; and a human hepatoma line (Hep G2).

Host cells are transformed with the above-described expression or cloning vectors can be cultured in conventional nutrient media modified as appropriate for inducing promoters, selecting transformants, or amplifying the cloning vectors.

For production of the polypeptide complex and the bispecific polypeptide complex provided herein, the host cells transformed with the expression vector may be cultured in a variety of media. Commercially available media such as Ham's F10 (Sigma), Minimal Essential Medium (MEM), (Sigma), RPMI-1640 (Sigma), and Dulbecco's Modified Eagle's Medium (DMEM), Sigma) are suitable for culturing the host cells. In addition, any of the media described in Ham et al., Meth. Enz. 58:44 (1979), Barnes et al., Anal. Biochem. 102:255 (1980), U.S. Pat. Nos. 4,767,704; 4,657, 866; 4,927,762; 4,560,655; or 5,122,469; WO 90/03430; WO 87/00195; or U.S. Pat. Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

In one aspect, the present disclosure provides a method of expressing the polypeptide complex and the bispecific polypeptide complex provided herein, comprising culturing the host cell provided herein under the condition at which the polypeptide complex, or the bispecific polypeptide complex is expressed.

In certain embodiments, the present disclosure provides a method of producing the polypeptide complex provided herein, comprising a) introducing to a host cell: a first polynucleotide encoding a first polypeptide comprising, from N-terminus to C-terminus, a first heavy chain variable domain (VH) of a first antibody operably linked to a first TCR constant region (C1), and a second polynucleotide encoding a second polypeptide comprising, from N-terminus to C-terminus, a first light chain variable domain (VL) of the first antibody operably linked to a second TCR constant region (C2), wherein: C1 and C2 are capable of forming a dimer comprising at least one non-native interchain bond between C1 and C2, and the non-native interchain bond is capable of stabilizing the dimer of C1 and C2, and the first antibody has a first antigenic specificity; b) allowing the host cell to express the polypeptide complex.

In certain embodiments, the present disclosure provides a method of producing the bispecific polypeptide complex provided herein, comprising a) introducing to a host cell: a first polynucleotide encoding a first polypeptide comprising, from N-terminus to C-terminus, a first heavy chain variable domain (VH) of a first antibody operably linked to a first TCR constant region (C1), a second polynucleotide encoding a second polypeptide comprising, from N-terminus to C-terminus, a first light chain variable domain (VL) of the first antibody operably linked to a second TCR constant region (C2), and one or more additional polynucleotides encoding a second antigen-binding moiety, wherein: C1 and C2 are capable of forming a dimer comprising at least one non-native interchain bond between a first mutated residue comprised in C1 and a second mutated residue comprised in C2, and the non-native interchain bond is capable of stabilizing the dimer of C1 and C2, the first antigen-binding moiety and the second antigen-binding moiety have reduced mispairing than otherwise would have been if the first antigen-binding moiety was a natural Fab counterpart, and the first antibody has a first antigenic specificity and the second antibody has a second antigenic specificity, b) allowing the host cell to express the bispecific polypeptide complex.

In certain embodiments, the method further comprises isolating the polypeptide complex.

When using recombinant techniques, the polypeptide complex, the bispecific polypeptide complex provided herein can be produced intracellularly, in the periplasmic space, or directly secreted into the medium. If the product is produced intracellularly, as a first step, the particulate debris, either host cells or lysed fragments, is removed, for example, by centrifugation or ultrafiltration. Carter et al., Bio/Technology 10:163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the product is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The polypeptide complex and the bispecific polypeptide complex provided herein prepared from the cells can be purified using, for example, hydroxylapatite chromatography, gel electrophoresis, dialysis, DEAE-cellulose ion exchange chromatography, ammonium sulfate precipitation, salting out, and affinity chromatography, with affinity chromatography being the preferred purification technique.

Where the polypeptide complex or the bispecific polypeptide complex provided herein comprises immunoglobulin Fc domain, then protein A can be used as an affinity ligand, depending on the species and isotype of the Fc domain that is present in the polypeptide complex. Protein A can be used for purification of polypeptide complexes based on human γ1, γ2, or γ4 heavy chains (Lindmark et al., J. Immunol. Meth. 62:1-13 (1983)). Protein G is recommended for all mouse isotypes and for human γ3 (Guss et al., EMBO J. 5:1567 1575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose.

Where the polypeptide complex or the bispecific polypeptide complex provided herein comprises a CH3 domain, the Bakerbond ABX resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered.

Following any preliminary purification step(s), the mixture comprising the polypeptide complex of interest and contaminants may be subjected to low pH hydrophobic interaction chromatography using an elution buffer at a pH between about 2.5-4.5, preferably performed at low salt concentrations (e.g., from about 0-0.25M salt).

In certain embodiments, the bispecific polypeptide complex provided herein can be readily purified with high yields using conventional methods. One of the advantages of the bispecific polypeptide complex is the significantly reduced mispairing between heavy chain and light chain variable domain sequences. This reduces production of unwanted byproducts and make it possible to obtain high purity product in high yields using relatively simple purification processes.

Derivatives

In certain embodiments, the polypeptide complex or the bispecific polypeptide complex can be used as the base of conjugation with desired conjugates.

It is contemplated that a variety of conjugates may be linked to the polypeptide complex or the bispecific polypeptide complex provided herein (see, for example, "Conjugate Vaccines", Contributions to Microbiology and Immunology, J. M. Cruse and R. E. Lewis, Jr. (eds.), Carger Press, New York, (1989)). These conjugates may be linked to the polypeptide complex or the bispecific polypeptide complex by covalent binding, affinity binding, intercalation, coordinate binding, complexation, association, blending, or addition, among other methods.

In certain embodiments, the polypeptide complex or the bispecific polypeptide complex provided herein may be engineered to contain specific sites outside the epitope binding portion that may be utilized for binding to one or more conjugates. For example, such a site may include one or more reactive amino acid residues, such as for example cysteine or histidine residues, to facilitate covalent linkage to a conjugate.

In certain embodiments, the polypeptide complex or the bispecific polypeptide complex may be linked to a conjugate indirectly, or indirectly for example through another conjugate or through a linker.

For example, the polypeptide complex or the bispecific polypeptide complex having a reactive residue such as cysteine may be linked to a thiol-reactive agent in which the reactive group is, for example, a maleimide, an iodoacetamide, a pyridyl disulphide, or other thiol-reactive conjugation partner (Haugland, 2003, Molecular Probes Handbook of Fluorescent Probes and Research Chemicals, Molecular Probes, Inc.; Brinkley, 1992, Bioconjugate Chem. 3:2; Garman, 1997, Non-Radioactive Labelling: A Practical Approach, Academic Press, London; Means (1990) Bioconjugate Chem. 1:2; Hermanson, G. in Bioconjugate Techniques (1996) Academic Press, San Diego, pp. 40-55, 643-671).

For another example, the polypeptide complex or the bispecific polypeptide complex may be conjugated to biotin, then indirectly conjugated to a second conjugate that is conjugated to avidin. For still another example, the polypeptide complex or the bispecific polypeptide complex may be linked to a linker which further links to the conjugate. Examples of linkers include bifunctional coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suherate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and his-active fluorine compounds (such as 1,5-difluoro-2,4-dinitrobenzene). Particularly preferred coupling agents include N-succinimidyl-3-(2-pyridyldithio) propionate (SPDP) (Carlsson et al., Biochem. J. 173:723-737 (1978)) and N-succinimidyl-4-(2-pyridylthio)pentanoate (SPP) to provide for a disulphide linkage.

The conjugate can be a detectable label, a pharmacokinetic modifying moiety, a purification moiety, or a cytotoxic moiety. Examples of detectable label may include a fluorescent labels (e.g. fluorescein, rhodamine, dansyl, phycoerythrin, or Texas Red), enzyme-substrate labels (e.g. horseradish peroxidase, alkaline phosphatase, luceriferases, glucoamylase, lysozyme, saccharide oxidases or β-D-galactosidase), radioisotopes (e.g. $^{123}$I, $^{124}$I, $^{125}$I, $^{131}$I, $^{35}$S, $^{3}$H, $^{111}$In, $^{112}$In, $^{14}$C, $^{64}$Cu, $^{67}$Cu, $^{86}$Y, $^{88}$Y, $^{90}$Y, $^{177}$Lu, $^{211}$At, $^{186}$Re, $^{188}$Re, $^{153}$Sm, $^{212}$Bi, and $^{32}$P, other lanthanides, luminescent labels), chromophoric moiety, digoxigenin, biotin/avidin, a DNA molecule or gold for detection. In certain embodiments, the conjugate can be a pharmacokinetic modifying moiety such as PEG which helps increase half-life of the antibody. Other suitable polymers include, such as, carboxymethylcellulose, dextran, polyvinyl alcohol, polyvinyl pyrrolidone, copolymers of ethylene glycol/propylene glycol, and the like. In certain embodiments, the conjugate can be a purification moiety such as a magnetic bead. A "cytotoxic moiety" can be any agent that is detrimental to cells or that can damage or kill cells. Examples of cytotoxic moiety include, without limitation, taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, puromycin and analogs thereof, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

Methods for the conjugation of conjugates to proteins such as antibodies, immunoglobulins or fragments thereof are found, for example, in U.S. Pat. Nos. 5,208,020; 6,441, 163; WO2005037992; WO2005081711; and WO2006/ 034488, which are incorporated herein by reference to the entirety.

Pharmaceutical Composition

The present disclosure also provides a pharmaceutical composition comprising the polypeptide complex or the bispecific polypeptide complex provided herein and a pharmaceutically acceptable carrier.

The term "pharmaceutically acceptable" indicates that the designated carrier, vehicle, diluent, excipient(s), and/or salt is generally chemically and/or physically compatible with the other ingredients comprising the formulation, and physiologically compatible with the recipient thereof.

A "pharmaceutically acceptable carrier" refers to an ingredient in a pharmaceutical formulation, other than an active ingredient, which is bioactivity acceptable and non-toxic to a subject. Pharmaceutical acceptable carriers for use in the pharmaceutical compositions disclosed herein may include, for example, pharmaceutically acceptable liquid, gel, or solid carriers, aqueous vehicles, nonaqueous vehicles, antimicrobial agents, isotonic agents, buffers, antioxidants, anesthetics, suspending/dispending agents, sequestering or chelating agents, diluents, adjuvants, excipients, or non-toxic auxiliary substances, other components known in the art, or various combinations thereof.

Suitable components may include, for example, antioxidants, fillers, binders, disintegrants, buffers, preservatives, lubricants, flavorings, thickeners, coloring agents, emulsifiers or stabilizers such as sugars and cyclodextrins. Suitable antioxidants may include, for example, methionine, ascorbic acid, EDTA, sodium thiosulfate, platinum, catalase, citric acid, cysteine, thioglycerol, thioglycolic acid, thiosorbitol, butylated hydroxanisol, butylated hydroxytoluene, and/or propyl gallate. As disclosed herein, inclusion of one or more antioxidants such as methionine in a pharmaceutical composition provided herein decreases oxidation of the polypeptide complex or the bispecific polypeptide complex. This reduction in oxidation prevents or reduces loss of binding affinity, thereby improving protein stability and maximizing shelf-life. Therefore, in certain embodiments, compositions are provided that comprise the polypeptide complex or the bispecific polypeptide complex disclosed herein and one or more antioxidants such as methionine.

To further illustrate, pharmaceutical acceptable carriers may include, for example, aqueous vehicles such as sodium chloride injection, Ringer's injection, isotonic dextrose injection, sterile water injection, or dextrose and lactated Ringer's injection, nonaqueous vehicles such as fixed oils of vegetable origin, cottonseed oil, corn oil, sesame oil, or peanut oil, antimicrobial agents at bacteriostatic or fungistatic concentrations, isotonic agents such as sodium chloride or dextrose, buffers such as phosphate or citrate buffers, antioxidants such as sodium bisulfate, local anesthetics such as procaine hydrochloride, suspending and dispersing agents such as sodium carboxymethylcelluose, hydroxypropyl methylcellulose, or polyvinylpyrrolidone, emulsifying agents such as Polysorbate 80 (TWEEN-80), sequestering or chelating agents such as EDTA (ethylenediaminetetraacetic acid) or EGTA (ethylene glycol tetraacetic acid), ethyl alcohol, polyethylene glycol, propylene glycol, sodium hydroxide, hydrochloric acid, citric acid, or lactic acid. Antimicrobial agents utilized as carriers may be added to pharmaceutical compositions in multiple-dose containers that include phenols or cresols, mercurials, benzyl alcohol, chlorobutanol, methyl and propyl p-hydroxybenzoic acid esters, thimerosal, benzalkonium chloride and benzethonium chloride. Suitable excipients may include, for example, water, saline, dextrose, glycerol, or ethanol. Suitable non-toxic auxiliary substances may include, for example, wetting or emulsifying agents, pH buffering agents, stabilizers, solubility enhancers, or agents such as sodium acetate, sorbitan monolaurate, triethanolamine oleate, or cyclodextrin.

The pharmaceutical compositions can be a liquid solution, suspension, emulsion, pill, capsule, tablet, sustained release formulation, or powder. Oral formulations can include standard carriers such as pharmaceutical grades of mannitol, lactose, starch, magnesium stearate, polyvinyl pyrollidone, sodium saccharine, cellulose, magnesium carbonate, etc.

In certain embodiments, the pharmaceutical compositions are formulated into an injectable composition. The injectable pharmaceutical compositions may be prepared in any conventional form, such as for example liquid solution, suspension, emulsion, or solid forms suitable for generating liquid solution, suspension, or emulsion. Preparations for injection may include sterile and/or non-pyretic solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use, and sterile and/or non-pyretic emulsions. The solutions may be either aqueous or nonaqueous.

In certain embodiments, unit-dose parenteral preparations are packaged in an ampoule, a vial or a syringe with a needle. All preparations for parenteral administration should be sterile and not pyretic, as is known and practiced in the art.

In certain embodiments, a sterile, lyophilized powder is prepared by dissolving the polypeptide complex or the bispecific polypeptide complex as disclosed herein in a suitable solvent. The solvent may contain an excipient which improves the stability or other pharmacological components of the powder or reconstituted solution, prepared from the powder. Excipients that may be used include, but are not limited to, water, dextrose, sorbital, fructose, corn syrup, xylitol, glycerin, glucose, sucrose or other suitable agent. The solvent may contain a buffer, such as citrate, sodium or potassium phosphate or other such buffer known to those of skill in the art at, in one embodiment, about neutral pH. Subsequent sterile filtration of the solution followed by lyophilization under standard conditions known to those of skill in the art provides a desirable formulation. In one embodiment, the resulting solution will be apportioned into vials for lyophilization. Each vial can contain a single dosage or multiple dosages of the polypeptide complex, the bispecific polypeptide complex provided herein or composition thereof. Overfilling vials with a small amount above that needed for a dose or set of doses (e.g., about 10%) is acceptable so as to facilitate accurate sample withdrawal and accurate dosing. The lyophilized powder can be stored under appropriate conditions, such as at about 4° C. to room temperature.

Reconstitution of a lyophilized powder with water for injection provides a formulation for use in parenteral administration. In one embodiment, for reconstitution the sterile and/or non-pyretic water or other liquid suitable carrier is added to lyophilized powder. The precise amount depends upon the selected therapy being given, and can be empirically determined.

Method of Treatment

Therapeutic methods are also provided, comprising: administering a therapeutically effective amount of the polypeptide complex or the bispecific polypeptide complex provided herein to a subject in need thereof, thereby treating or preventing a condition or a disorder. In certain embodiments, the subject has been identified as having a disorder or condition likely to respond to the polypeptide complex or the bispecific polypeptide complex provided herein.

"Treating" or "treatment" of a condition as used herein includes preventing or alleviating a condition, slowing the onset or rate of development of a condition, reducing the risk of developing a condition, preventing or delaying the development of symptoms associated with a condition, reducing or ending symptoms associated with a condition, generating a complete or partial regression of a condition, curing a condition, or some combination thereof.

The therapeutically effective amount of the polypeptide complex and the bispecific polypeptide complex provided herein will depend on various factors known in the art, such as for example body weight, age, past medical history, present medications, state of health of the subject and potential for cross-reaction, allergies, sensitivities and adverse side-effects, as well as the administration route and extent of disease development. Dosages may be proportionally reduced or increased by one of ordinary skill in the art (e.g., physician or veterinarian) as indicated by these and other circumstances or requirements.

In certain embodiments, the polypeptide complex or the bispecific polypeptide complex provided herein may be administered at a therapeutically effective dosage of about 0.01 mg/kg to about 100 mg/kg (e.g., about 0.01 mg/kg, about 0.5 mg/kg, about 1 mg/kg, about 2 mg/kg, about 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, or about 100 mg/kg). In certain of these embodiments, the polypeptide complex or the bispecific polypeptide complex provided herein is administered at a dosage of about 50 mg/kg or less, and in certain of these embodiments the dosage is 10 mg/kg or less, 5 mg/kg or less, 1 mg/kg or less, 0.5 mg/kg or less, or 0.1 mg/kg or less. In certain embodiments, the administration dosage may change over the course of treatment. For example, in certain embodiments the initial administration dosage may be higher than subsequent administration dosages. In certain embodiments, the administration dosage may vary over the course of treatment depending on the reaction of the subject.

Dosage regimens may be adjusted to provide the optimum desired response (e.g., a therapeutic response). For example, a single dose may be administered, or several divided doses may be administered over time.

The polypeptide complex or the bispecific polypeptide complex provided herein may be administered by any route known in the art, such as for example parenteral (e.g., subcutaneous, intraperitoneal, intravenous, including intravenous infusion, intramuscular, or intradermal injection) or non-parenteral (e.g., oral, intranasal, intraocular, sublingual, rectal, or topical) routes.

In certain embodiments, the condition or disorder treated by the polypeptide complex or the bispecific polypeptide complex provided herein is cancer or a cancerous condition, autoimmune diseases, infectious and parasitic diseases, cardiovascular diseases, neuropathies, neuropsychiatric conditions, injuries, inflammations, or coagulation disorder.

"Cancer" or "cancerous condition" as used herein refers to any medical condition mediated by neoplastic or malignant cell growth, proliferation, or metastasis, and includes both solid cancers and non-solid cancers such as leukemia. "Tumor" as used herein refers to a solid mass of neoplastic and/or malignant cells.

With regard to cancer, "treating" or "treatment" may refer to inhibiting or slowing neoplastic or malignant cell growth, proliferation, or metastasis, preventing or delaying the development of neoplastic or malignant cell growth, proliferation, or metastasis, or some combination thereof. With regard to a tumor, "treating" or "treatment" includes eradicating all or part of a tumor, inhibiting or slowing tumor growth and metastasis, preventing or delaying the development of a tumor, or some combination thereof.

For example, with regard to the use of the polypeptide complex or bispecific polypeptide complex disclosed herein to treat cancer, a therapeutically effective amount is the dosage or concentration of the polypeptide complex capable of eradicating all or part of a tumor, inhibiting or slowing tumor growth, inhibiting growth or proliferation of cells mediating a cancerous condition, inhibiting tumor cell metastasis, ameliorating any symptom or marker associated with a tumor or cancerous condition, preventing or delaying the development of a tumor or cancerous condition, or some combination thereof.

In certain embodiments, the conditions and disorders include tumors and cancers, for example, non-small cell lung cancer, small cell lung cancer, renal cell cancer, colorectal cancer, ovarian cancer, breast cancer, pancreatic cancer, gastric carcinoma, bladder cancer, esophageal cancer, mesothelioma, melanoma, head and neck cancer, thyroid cancer, sarcoma, prostate cancer, glioblastoma, cervical cancer, thymic carcinoma, leukemia, lymphomas, myelomas, mycoses fungoids, merkel cell cancer, and other hematologic malignancies, such as classical Hodgkin lymphoma (CHL), primary mediastinal large B-cell lymphoma, T-cell/histiocyte-rich B-cell lymphoma, EBV-positive and -negative PTLD, and EBV-associated diffuse large B-cell lymphoma (DLBCL), plasmablastic lymphoma, extranodal NK/T-cell lymphoma, nasopharyngeal carcinoma, and HHV8-associated primary effusion lymphoma, Hodgkin's lymphoma, neoplasm of the central nervous system (CNS), such as primary CNS lymphoma, spinal axis tumor, brain stem glioma.

In certain embodiments, the conditions and disorders include a CD19-related disease or condition, such as, B cell lymphoma, optionally Hodgkin lymphoma or non-Hodgkin lymphoma, wherein the non-Hodgkin lymphoma comprises: Diffuse large B-cell lymphoma (DLBCL), Follicular lymphoma, Marginal zone B-cell lymphoma (MZL), Mucosa-Associated Lymphatic Tissue lymphoma (MALT), Small lymphocytic lymphoma (chronic lymphocytic leukemia, CLL), or Mantle cell lymphoma (MCL), Acute Lymphoblastic Leukemia (ALL), or Waldenstrom's Macroglobulinemia (WM).

In certain embodiments, the conditions and disorders include hyperproliferative conditions or infectious diseases that can be treated via regulation of immune responses by CTLA-4 and/or PD-1. Examples of hyperproliferative conditions include, but are not limited to, solid tumors, hematological cancers, soft tissue tumors, and metastatic lesions.

The polypeptide complex or the bispecific polypeptide complex may be administered alone or in combination with one or more additional therapeutic means or agents.

In certain embodiments, when used for treating cancer or tumor or prolierative disease, the polypeptide complex or the bispecific polypeptide complex provided herein may be administered in combination with chemotherapy, radiation therapy, surgery for the treatment of cancer (e.g., tumorectomy), one or more anti-emetics or other treatments for complications arising from chemotherapy, or any other therapeutic agent for use in the treatment of cancer or any medical disorder that related. "Administered in combination" as used herein includes administration simultaneously as part of the same pharmaceutical composition, simultaneously as separate compositions, or at different timings as separate compositions. A composition administered prior to or after another agent is considered to be administered "in combination" with that agent as the phrase is used herein, even if the composition and the second agent are administered via different routes. Where possible, additional therapeutic agents administered in combination with the polypeptide complex or the bispecific polypeptide complex provided herein are administered according to the schedule listed in the product information sheet of the additional therapeutic agent, or according to the Physicians' Desk Reference (Physicians' Desk Reference, 70th Ed (2016)) or protocols well known in the art.

In certain embodiments, the therapeutic agents can induce or boost immune response against cancer. For example, a tumor vaccine can be used to induce immune response to certain tumor or cancer. Cytokine therapy can also be used to enhance tumor antigen presentation to the immune system. Examples of cytokine therapy include, without limitation, interferons such as interferon-α, -β, and -γ, colony stimulating factors such as macrophage-CSF, granulocyte macrophage CSF, and granulocyte-CSF, interleukins such IL-1, IL-1α, IL-2, IL-3, IL-4, IL-5, IL-6, IL-7, IL-8, IL-9, IL-10, IL-11, and IL-12, tumor necrosis factors such as TNF-α and TNF-β. Agents that inactivate immunosuppressive targets can also be used, for example, TGF-beta inhibitors, IL-10 inhibitors, and Fas ligand inhibitors. Another group of agents include those that activate immune responsiveness to tumor or cancer cells, for example, those enhance T cell activation (e.g. agonist of T cell costimulatory molecules such as CTLA-4, ICOS and OX-40), and those enhance dendritic cell function and antigen presentation.

Kits

The present disclosure further provides kits comprising the polypeptide complex or the bispecific polypeptide complex provided herein. In some embodiments, the kits are useful for detecting the presence or level of, or capturing or enriching one or more target of interest in a biological sample. The biological sample can comprise a cell or a tissue.

In some embodiments, the kit comprises the polypeptide complex or the bispecific polypeptide complex provided herein which is conjugated with a detectable label. In certain other embodiments, the kit comprises an unlabeled polypeptide complex or the bispecific polypeptide complex provided herein, and further comprises a secondary labeled antibody which is capable of binding to the unlabeled polypeptide complex or the bispecific polypeptide complex provided herein. The kit may further comprise an instruction of use, and a package that separates each of the components in the kit.

In certain embodiments, the polypeptide complex or the bispecific polypeptide complex provided herein are associated with a substrate or a device. Useful substrate or device can be, for example, magnetic beads, microtiter plate, or test strip. Such can be useful for a binding assay (such as ELISA), an immunographic assay, capturing or enriching of a target molecule in a biological sample.

The following examples are provided to better illustrate the claimed invention and are not to be interpreted as limiting the scope of the invention. All specific compositions, materials, and methods described below, in whole or in part, fall within the scope of the present invention. These specific compositions, materials, and methods are not intended to limit the invention, but merely to illustrate specific embodiments falling within the scope of the invention. One skilled in the art may develop equivalent compositions, materials, and methods without the exercise of inventive capacity and without departing from the scope of the invention. It will be understood that many variations can be made in the procedures herein described while still remaining within the bounds of the present invention. It is the intention of the inventors that such variations are included within the scope of the invention.

TABLE 11

Designs and names of chimeric constant regions (CBeta/CAlpha)

| Template designs based on Table 16 | SEQ ID NOs: (Heavy Chain (HC)/Light Chain (LC))-IgG1 |
|---|---|
| Design_1 | 177/176 |
| Design_2 | 179/178 |
| Design_3 | 184/183 |
| Design_4 | 185/183 |
| Design_5 | 180/176 |
| Design_6 | 181/178 |
| Design_6a | 182/178 |
| Design_7 | 184/186 |
| Design_8 | 185/186 |

TABLE 12

Domains and SEQ ID NOS of chimeric constant regions (CBeta/CAlpha)

| Chimeric constant region name and chain SEQ ID NOs: | First or Second Conjunction domain (CJ) | TCR Constant Domain (C1 or C2) | Third Conjunction domain + Hinge (CJ') | Dimerization Domain (D) |
|---|---|---|---|---|
| Design_1 HC SEQ ID NO: 177 | HCJ1 SEQ ID NO: 49 | Cbeta(S56C) SEQ ID NO: 33 | CJ'1G1 SEQ ID NO: 53 | FcG1 SEQ ID NO: 302 |
| Design_1 LC SEQ ID NO: 176 | LCJ1 SEQ ID NO: 51 | CAlpha(T49C) SEQ ID NO: 43 | | |
| Design_2 HC SEQ ID NO: 179 | HCJ2 SEQ ID NO: 50 | Cbeta(S56C) SEQ ID NO: 33 | CJ'1G1 SEQ ID NO: 53 | FcG1 SEQ ID NO: 302 |
| Design_2 LC SEQ ID NO: 178 | LCJ2 SEQ ID NO: 52 | CAlpha(T49C) SEQ ID NO: 43 | | |
| Design_3 HC SEQ ID NO: 184 | HCJ3 SEQ ID NO: 129 | CAlpha(T49C) SEQ ID NO: 43 | CJ'2G1 SEQ ID NO: 134 | FcG1 SEQ ID NO: 302 |
| Design_3 LC SEQ ID NO: 183 | LCJ3 SEQ ID NO: 308 | Cbeta(S56C) SEQ ID NO: 33 + NO: 306 | | |
| Design_4 HC SEQ ID NO: 185 | HCJ4 SEQ ID NO: 130 | CAlpha(T49C) SEQ ID NO: 43 | CJ'2G1 SEQ ID NO: 134 | FcG1 SEQ ID NO: 302 |
| Design_4 LC SEQ ID NO: 183 | LCJ3 SEQ ID NO: 308 | Cbeta(S56C) SEQ ID NO: 33 + NO: 306 | | |
| Design_5 HC SEQ ID NO: 180 | HCJ1 SEQ ID NO: 49 | Cbeta(S56C) (FG-) SEQ ID NO: 37 | CJ'1G1 SEQ ID NO: 53 | FcG1 SEQ ID NO: 302 |
| Design_5 LC SEQ ID NO: 176 | LCJ1 SEQ ID NO: 51 | CAlpha(T49C) SEQ ID NO: 43 | | |
| Design_6 HC SEQ ID NO: 181 | HCJ1 SEQ ID NO: 50 | CBeta(S56C)(FG-) SEQ ID NO: 37 | CJ'1G1 SEQ ID NO: 53 | FcG1 SEQ ID NO: 302 |
| Design_6 LC SEQ ID NO: 178 | LCJ2 SEQ ID NO: 52 | CAlpha(T49C) SEQ ID NO: 43 | | |
| Design_6a HC SEQ ID NO: 182 | HCJ2 SEQ ID NO: 50 | CBeta(S56C)(DE-FG-) SEQ ID NO: 41 | CJ'1G1 SEQ ID NO: 53 | FcG1 SEQ ID NO: 302 |
| Design_6a LC SEQ ID NO: 178 | LCJ2 SEQ ID NO: 52 | CAlpha(T49C) SEQ ID NO: 43 | | |
| Design_7 HC SEQ ID NO: 184 | HCJ3 SEQ ID NO: 129 | CAlpha(T49C) SEQ ID NO: 43 | CJ'2G1 SEQ ID NO: 134 | FcG1 SEQ ID NO: 302 |
| Design_7 LC SEQ ID NO: 186 | LCJ3 SEQ ID NO: 308 | CBeta(S56C)(FG-) SEQ ID NO: 37 + NO: 306 | | |
| Design_8 HC SEQ ID NO: 185 | HCJ4 SEQ ID NO: 130 | CAlpha(T49C) SEQ ID NO: 43 | CJ'2G1 SEQ ID NO: 134 | FcG1 SEQ ID NO: 302 |
| Design_8 LC SEQ ID NO: 186 | LCJ3 SEQ ID NO: 308 | CBeta(S56C)(FG-) SEQ ID NO: 37 + NO: 306 | | |

TABLE 13

Designs and names of Design_2 (CBeta/CAlpha) without glycosylation sites

| Sample | SEQ ID NO: (HC-CBeta/LC-CAlpha) HC/LC |
|---|---|
| Design_2-QQQQ | 188/187 (IgG1) |
| | 196/187 (IgG4) |
| Design_2-AAAA | 190/189 (IgG1) |
| Design_2-QSKE | 192/191 (IgG1) |
| Design_2-ASKE | 192/193 (IgG1) |
| Design_2-QQQQQ | 195/194 (IgG1) |

TABLE 14

Domains and SEQ ID NOs of Design_2 (CBeta/CAlpha) without glycosylation sites

| Complex name and chain SEQ ID NOs: | First or Second Conjunction domain (CJ) | TCR Constant Domain (C1 or C2) | Third Conjunction domain + Hinge (CJ') | Dimerization Domain (D) |
|---|---|---|---|---|
| Design_2-QQQQ (IgG1) HC SEQ ID NO: 188 | HCJ2 SEQ ID NO: 50 | CBeta(S56C) (N69Q) SEQ ID NO: 34 | CJ'1G1 SEQ ID NO: 53 | FcG1 SEQ ID NO: 302 |

TABLE 14-continued

Domains and SEQ ID NOs of Design_2 (CBeta/CAlpha) without glycosylation sites

Domains from N-terminal to C-terminal and their SEQ ID NOs

| Complex name and chain SEQ ID NOs: | First or Second Conjunction domain (CJ) | TCR Constant Domain (C1 or C2) | Third Conjunction domain + Hinge (CJ') | Dimerization Domain (D) |
|---|---|---|---|---|
| Design_2-QQQQ (IgG1) LC | LCJ2 | CAlpha(T49C) (N34Q + N68Q + N79Q) | | |
| SEQ ID NO: 187 | SEQ ID NO: 52 | SEQ ID NO: 44 | | |
| Design_2-QQQQ (IgG4) HC | HCJ2 | CBeta(S56C) (N69Q) | CJ'1G4 | FcG4 |
| SEQ ID NO: 196 | SEQ ID NO: 50 | SEQ ID NO: 34 | SEQ ID NO: 54 | SEQ ID NO: 303 |
| Design_2-QQQQ (IgG4) LC | LCJ2 | CAlpha(T49C) (N34Q + N68Q + N79Q) | | |
| SEQ ID NO: 187 | SEQ ID NO: 52 | SEQ ID NO: 44 | | |
| Design_2-AAAA (IgG1) HC | HCJ2 | CBeta(S56C) (N69A) | CJ'1G1 | FcG1 |
| SEQ ID NO: 190 | SEQ ID NO: 50 | SEQ ID NO: 35 | SEQ ID NO: 53 | SEQ ID NO: 302 |
| Design_2-AAAA (IgG1) LC | LCJ2 | CAlpha(T49C) (N34A + N68A + N79A) | | |
| SEQ ID NO: 189 | SEQ ID NO: 52 | SEQ ID NO: 45 | | |
| Design_2-QSKE (IgG1) HC | HCJ2 | CBeta(S56C) (N69E) | CJ'1G1 | FcG1 |
| SEQ ID NO: 192 | SEQ ID NO: 50 | SEQ ID NO: 36 | SEQ ID NO: 53 | SEQ ID NO: 302 |
| Design_2-QSKE (IgG1) LC | LCJ2 | CAlpha(T49C) (N34Q + N68S + N79K) | | |
| SEQ ID NO: 191 | SEQ ID NO: 52 | SEQ ID NO: 46 | | |
| Design_2-ASKE (IgG1) HC | HCJ2 | CBeta(S56C) (N69E) | CJ'1G1 | FcG1 |
| SEQ ID NO: 192 | SEQ ID NO: 50 | SEQ ID NO: 36 | SEQ ID NO: 53 | SEQ ID NO: 302 |
| Design_2-ASKE (IgG1) LC | LCJ2 | CAlpha(T49C) (N34A + N68S + N79K) | | |
| SEQ ID NO: 191 | SEQ ID NO: 52 | SEQ ID NO: 47 | | |
| Design_2-QQQQQ (IgG1) HC | HCJ2 | CBeta(S56C) (N69Q) | CJ'1G1 | FcG1 |
| SEQ ID NO: 195 | SEQ ID NO: 50 | SEQ ID NO: 34 | SEQ ID NO: 53 | SEQ ID NO: 302 |
| Design_2-QQQQQ (IgG1) LC | LCJ2 | CAlpha(T49C) (N34Q + N68Q + N79Q + N61Q) | | |
| SEQ ID NO: 194 | SEQ ID NO: 52 | SEQ ID NO: 48 | | |

TABLE 15

Designs and names of chimeric constant regions (CBeta/Cpre-Alpha)

| Templates based on Table 16 (IgG1) | Sequence file | SEQ ID NOs: |
|---|---|---|
| PreTCR_Design_B | Design_1_Pre_TCR_Conjunction'1 | 198/197 |
| | Design_2_Pre_TCR_Conjunction'_1_Cys10 | 200/199 |
| | Design_3_Pre_TCR_Conjunction'_1_Cys11 | 202/201 |
| | Design_4_Pre_TCR_Conjunction'_1_Cys12 | 203/201 |
| | Design_5_Pre_TCR_Conjunction'_1_Cys13 | 203/204 |
| | Design_6_Pre_TCR_Conjunction'_1_Cys14 | 205/204 |
| | Design_7_Pre_TCR_Conjunction'_1_Cys15 | 206/204 |
| | Design_8_Pre_TCR_Conjunction'_1_Cys1_4L4T_1 | 208/207 |
| | Design_9_Pre_TCR_Conjunction'_1_Cys2_4L4T_2 | 208/209 |
| | Design_10_Pre_TCR_Conjunction'_1_Cys4 | 211/210 |
| PreTCR_Design_C | PreTCR_Design_5_crossed_1 | 213/212 |
| | PreTCR_Design_6_crossed_1 | 213/215 |
| PreTCR_Design_D | PreTCR_Design_5_crossed_2 | 214/212 |
| | PreTCR_Design_6_crossed_2 | 214/215 |

TABLE 16

Domains and SEQ ID NOs of chimeric constant regions (CBeta/Cpre-Alpha)

Domains from N-terminal to C-terminal and their SEQ ID NOs

| Complex name and chain SEQ ID NOs: | First or Second Conjunction domain (CJ) | TCR Constant Domain (C1 or C2) | Third Conjunction domain + Hinge (CJ') | Dimerization Domain (D) |
|---|---|---|---|---|
| Design_1_Pre_TCR_Conjunction'1 HC SEQ ID NO: 198 | HCJB SEQ ID NO: 50 | CBeta(N69Q) SEQ ID NO: 84 | CJ'1G1 SEQ ID NO: 53 | FcG1 SEQ ID NO: 302 |
| Design_1_Pre_TCR_Conjunction'1 LC SEQ ID NO: 197 | LCJB SEQ ID NO: 309 | CPreAlpha(N50Q) SEQ ID NO: 83 | | |
| Design_2_Pre_TCR_Conjunction'_1_Cys10 HC SEQ ID NO: 200 | HCJB SEQ ID NO: 50 | Cbeta(S76C)(N69Q) SEQ ID NO: 319 | CJ'1G1 SEQ ID NO: 53 | FcG1 SEQ ID NO: 302 |
| Design_2_Pre_TCR_Conjunction'_1_Cys10 LC SEQ ID NO: 199 | LCJB SEQ ID NO: 309 | CPreAlpha (Y59C)(N50Q) SEQ ID NO: 311 | | |
| Design_3_Pre_TCR_Conjunction'_1_Cys11 HC SEQ ID NO: 202 | HCJB SEQ ID NO: 50 | Cbeta(F13C)(N69Q) SEQ ID NO: 320 | CJ'1G1 SEQ ID NO: 53 | FcG1 SEQ ID NO: 302 |
| Design_3_Pre_TCR_Conjunction'_1_Cys11 LC SEQ ID NO: 201 | LCJB SEQ ID NO: 309 | CPreAlpha (A13C)(N50Q) SEQ ID NO: 312 | | |
| Design_4_Pre_TCR_Conjunction'_1_Cys12 HC SEQ ID NO: 203 | HCJB SEQ ID NO: 50 | Cbeta(S16C)(N69Q) SEQ ID NO: 321 | CJ'1G1 SEQ ID NO: 53 | FcG1 SEQ ID NO: 302 |
| Design_4_Pre_TCR_Conjunction'_1_Cys12 LC SEQ ID NO: 201 | LCJB SEQ ID NO: 309 | CPreAlpha (A13C)(N50Q) SEQ ID NO: 312 | | |
| Design_5_Pre_TCR_Conjunction'_1_Cys13 HC SEQ ID NO: 203 | HCJB SEQ ID NO: 50 | Cbeta(S16C)(N69Q) SEQ ID NO: 321 | CJ'1G1 SEQ ID NO: 53 | FcG1 SEQ ID NO: 302 |
| Design_5_Pre_TCR_Conjunction'_1_Cys13 LC SEQ ID NO: 204 | LCJB SEQ ID NO: 309 | CPreAlpha (S11C)(N50Q) SEQ ID NO: 313 | | |
| Design_6_Pre_TCR_Conjunction'_1_Cys14 HC SEQ ID NO: 205 | HCJB SEQ ID NO: 50 | Cbeta(A18C)(N69Q) SEQ ID NO: 322 | CJ'1G1 SEQ ID NO: 53 | FcG1 SEQ ID NO: 302 |
| Design_6_Pre_TCR_Conjunction'_1_Cys14 LC SEQ ID NO: 204 | LCJB SEQ ID NO: 309 | CPreAlpha (S11C)(N50Q) SEQ ID NO: 313 | | |
| Design_7_Pre_TCR_Conjunction'_1_Cys15 HC SEQ ID NO: 206 | HCJB SEQ ID NO: 50 | Cbeta(E19C)(N69Q) SEQ ID NO: 323 | CJ'1G1 SEQ ID NO: 53 | FcG1 SEQ ID NO: 302 |
| Design_7_Pre_TCR_Conjunction'_1_Cys15 LC SEQ ID NO: 204 | LCJB SEQ ID NO: 309 | CPreAlpha (S11C)(N50Q) SEQ ID NO: 313 | | |
| Design_8_Pre_TCR_Conjunction'_1_Cys1_4L4T_1 HC SEQ ID NO: 208 | HCJB SEQ ID NO: 50 | Cbeta(S56C)(N69Q) SEQ ID NO: 34 | CJ'1G1 SEQ ID NO: 53 | FcG1 SEQ ID NO: 302 |
| Design_8_Pre_TCR_Conjunction'_1_Cys1_4L4T_1 LC SEQ ID NO: 207 | LCJB SEQ ID NO: 309 | CPreAlpha (S62C)(N50Q) SEQ ID NO: 314 | | |
| Design_9_Pre_TCR_Conjunction'_1_Cys2_4L4T_2 HC SEQ ID NO: 207 | HCJB SEQ ID NO: 50 | Cbeta(S56C)(N69Q) SEQ ID NO: 34 | CJ'1G1 SEQ ID NO: 53 | FcG1 SEQ ID NO: 302 |
| Design_9_Pre_TCR_Conjunction'_1_Cys2_4L4T_2 LC SEQ ID NO: 209 | LCJB SEQ ID NO: 309 | CPreAlpha (T65C)(N50Q) SEQ ID NO: 315 | | |
| Design_10_Pre_TCR_Conjunction'_1_Cys4 HC SEQ ID NO: 211 | HCJB SEQ ID NO: 50 | Cbeta(A11C)(N69Q) SEQ ID NO: 324 | CJ'1G1 SEQ ID NO: 53 | FcG1 SEQ ID NO: 302 |
| Design_10_Pre_TCR_Conjunction'_1_Cys4 LC SEQ ID NO: 210 | LCJB SEQ ID NO: 309 | CPreAlpha (I16C)(N50Q) SEQ ID NO: 316 | | |
| PreTCR_Design_5_crossed_1 HC SEQ ID NO: 213 | HCJC SEQ ID NO: 132 | CPreAlpha (S11C)(N50Q) SEQ ID NO: 313 | CJ'2G1 SEQ ID NO: 134 | FcG1 SEQ ID NO: 302 |
| PreTCR_Design_5_crossed_1 LC SEQ ID NO: 212 | LCJC SEQ ID NO: 50 | Cbeta (N69Q, S16C) SEQ ID NO: 321 + 306 | | |
| PreTCR_Design_6_crossed_1 HC SEQ ID NO: 213 | HCJC SEQ ID NO: 132 | CPreAlpha (S11C)(N50Q) SEQ ID NO: 313 | CJ'2G4 SEQ ID NO: 134 | FcG4 SEQ ID NO: 303 |
| PreTCR_Design_6_crossed_1 LC SEQ ID NO: 215 | LCJC SEQ ID NO: 50 | Cbeta(N69Q, A18C) SEQ ID NO: 322 + 306 | | |
| PreTCR_Design_5_crossed_2 HC SEQ ID NO: 214 | HCJD | CPreAlpha (S11C)(N50Q) | CJ'2G1 | FcG1 |
| PreTCR_Design_5_crossed_2 LC SEQ ID NO: 212 | | | | |

TABLE 16-continued

Domains and SEQ ID NOs of chimeric constant regions (CBeta/Cpre-Alpha)

| Complex name and chain SEQ ID NOs: | First or Second Conjunction domain (CJ) | TCR Constant Domain (C1 or C2) | Third Conjunction domain + Hinge (CJ') | Dimerization Domain (D) |
|---|---|---|---|---|
| PreTCR_Design_6_crossed_2 HC SEQ ID NO: 214 | SEQ ID NO: 133 LCJC | SEQ ID NO: 313 Cbeta (N69Q, S16C) | SEQ ID NO: 134 | SEQ ID NO: 302 |
| PreTCR_Design_6_crossed_2 LC SEQ ID NO: 215 | SEQ ID NO: 50 HCJD | SEQ ID NO: 321 + 306 CPreAlpha (S11C)(N50Q) | CJ'2G1 | FcG1 |

TABLE 17

Designs and names of chimeric constant regions (CGamma/CDelta)

| Templates based on Table 13 (IgG1) | Construct of Design | SEQ ID NOs in HC/LC |
|---|---|---|
| dg_Design_1 | dg_Design_1 | 234/233 |
| dg_Design_2 | dg_Design_2 | 232/231 |
|  | dg_Design_2_no_Glyco | 216/215 |
|  | dg_Design_2_hypeCys1_no_Glyco | 218/217 |
|  | dg_Design_2_hypeCys2_no_Glyco | 220/219 |
|  | dg_Design_2_hypeCys3_no_Glyco | 222/221 |
|  | dg_Design_2_Cys2_no_Glyco | 224/223 |
|  | dg_Design_2_Cys1_no_Glyco | 226/225 |
|  | dg_Design_2_Cys3_no_Glyco | 227/223 |
|  | dg_Design_2_Cys4_no_Glyco | 229/228 |
|  | dg_Design_2_Cys5_no_Glyco | 229/230 |
| dg_Design_3 | dg_crossed_Design_1 | 236/235 |
| dg_Design_4 | dg_crossed_Deisng_2 | 238/237 |

TABLE 18

Domains and SEQ ID NOs of chimeric constant regions (CGamma/CDelta)

| Complex name and chain SEQ ID NOs: | First or Second Conjunction domain (CJ) | TCR Constant Domain (C1 or C2) | Third Conjunction domain + Hinge (CJ') | Dimerization Domain (D) |
|---|---|---|---|---|
| dg_Design_1 HC SEQ ID NO: 234 | HCJ4 SEQ ID NO: 117 | CGamma SEQ ID NO: 113 | CJ'3G1 SEQ ID NO: 121 | FcG1 SEQ ID NO: 302 |
| dg_Design_1 LC SEQ ID NO: 233 | LCJ4 SEQ ID NO: 119 | CDelta SEQ ID NO: 310 |  |  |
| dg_Design_2 HC SEQ ID NO: 232 | HCJ5 SEQ ID NO: 118 | CGamma SEQ ID NO: 113 | CJ'3G1 SEQ ID NO: 121 | FcG1 SEQ ID NO: 302 |
| dg_Design_2 LC SEQ ID NO: 231 | LCJ5 SEQ ID NO: 120 | CDelta SEQ ID NO: 115 |  |  |
| dg_Design_2_no_Glyco HC SEQ ID NO: 216 | HCJ5 SEQ ID NO: 118 | CGamma (N65Q) SEQ ID NO: 114 | CJ'3G1 SEQ ID NO: 121 | FcG1 SEQ ID NO: 302 |
| dg_Design_2_no_Glyco LC SEQ ID NO: 215 | LCJ5 SEQ ID NO: 120 | CDelta(N16Q + N79Q) SEQ ID NO: 116 |  |  |
| dg_Design_2_hypeCys1_no_Glyco HC SEQ ID NO: 218 | HCJ5 SEQ ID NO: 118 | CGamma(T12C) (N65Q) SEQ ID NO: 333 | CJ'3G1 SEQ ID NO: 121 | FcG1 SEQ ID NO: 302 |
| dg_Design_2_hypeCys1_no_Glyco LC SEQ ID NO: 217 | LCJ5 SEQ ID NO: 120 | CDelta (N16C) (N79Q) SEQ ID NO: 325 |  |  |
| dg_Design_2_hypeCys2_no_Glyco HC SEQ ID NO: 220 | HCJ5 SEQ ID NO: 118 | CGamma (Q57C) (N65Q) SEQ ID NO: 334 | CJ'3G1 SEQ ID NO: 121 | FcG1 SEQ ID NO: 302 |
| dg_Design_2_hypeCys2_no_Glyco LC SEQ ID NO: 219 | LCJ5 SEQ ID NO: 120 | CDelta (V50C) (N16Q + N79Q) SEQ ID NO: 326 |  |  |
| dg_Design_2_hypeCys3_no_Glyco HC | HCJ5 | CGamma (M62C) (N65Q) | CJ'3G1 | FcG1 |

TABLE 18-continued

Domains and SEQ ID NOs of chimeric constant regions (CGamma/CDelta)

Domains from N-terminal to C-terminal and their SEQ ID NOs

| Complex name and chain SEQ ID NOs: | First or Second Conjunction domain (CJ) | TCR Constant Domain (C1 or C2) | Third Conjunction domain + Hinge (CJ') | Dimerization Domain (D) |
|---|---|---|---|---|
| SEQ ID NO: 222 dg_Design_2_hypeCys3_no_Glyco LC | SEQ ID NO: 118 LCJ5 | SEQ ID NO: 335 CDelta (D46C) (N16Q + N79Q) | SEQ ID NO: 121 | SEQ ID NO: 302 |
| SEQ ID NO: 221 dg_Design_2_Cys2_no_Glyco HC | SEQ ID NO: 120 HCJ5 | SEQ ID NO: 327 CGamma(S17C) (N65Q) | CJ'3G1 | FcG1 |
| SEQ ID NO: 224 dg_Design_2_Cys2_no_Glyco LC | SEQ ID NO: 118 LCJ5 | SEQ ID NO: 336 CDelta (F12C) (N16Q + N79Q) | SEQ ID NO: 121 | SEQ ID NO: 302 |
| SEQ ID NO: 223 dg_Design_2_Cys1_no_Glyco HC | SEQ ID NO: 120 HCJ5 | SEQ ID NO: 328 CGamma(F14C) (N65Q) | CJ'3G1 | FcG1 |
| SEQ ID NO: 226 dg_Design_2_Cys1_no_Glyco LC | SEQ ID NO: 118 LCJ5 | SEQ ID NO: 337 CDelta(M14C) (N16Q + N79Q) | SEQ ID NO: 121 | SEQ ID NO: 302 |
| SEQ ID NO: 225 dg_Design_2_Cys3_no_Glyco HC | SEQ ID NO: 120 HCJ5 | SEQ ID NO: 329 CGamma (E20C) (N65Q) | CJ'3G1 | FcG1 |
| SEQ ID NO: 227 dg_Design_2_Cys3_no_Glyco LC | SEQ ID NO: 118 LCJ5 | SEQ ID NO: 338 CDelta (F12C) (N16Q + N79Q) | SEQ ID NO: 121 | SEQ ID NO: 302 |
| SEQ ID NO: 223 dg_Design_2_Cys4_no_Glyco HC | SEQ ID NO: 120 HCJ5 | SEQ ID NO: 328 CGamma (A19C) (N65Q) | CJ'3G1 | FcG1 |
| SEQ ID NO: 229 dg_Design_2_Cys4_no_Glyco LC | SEQ ID NO: 118 LCJ5 | SEQ ID NO: 339 CDelta(F87C) (N16Q + N79Q) | SEQ ID NO: 121 | SEQ ID NO: 302 |
| SEQ ID NO: 228 dg_Design_2_Cys5_no_Glyco HC | SEQ ID NO: 120 HCJ5 | SEQ ID NO: 330 CGamma (A19C) (N65Q) | CJ'3G1 | FcG1 |
| SEQ ID NO: 229 dg_Design_2_Cys5_no_Glyco LC | SEQ ID NO: 118 LCJ5 | SEQ ID NO: 339 CDelta (E88C) (N16Q + N79Q) | SEQ ID NO: 121 | SEQ ID NO: 302 |
| SEQ ID NO: 230 dg_crossed_Design_1 HC | SEQ ID NO: 120 HCJ6 | SEQ ID NO: 331 CDelta | CJ'4G1 | FcG1 |
| SEQ ID NO: 236 dg_crossed_Design_1 LC SEQ ID NO: 235 | SEQ ID NO: 123 LCJ6 SEQ ID NO: 125 | SEQ ID NO: 332 CGamma SEQ ID NO: 340 | SEQ ID NO: 127 | SEQ ID NO: 302 |
| dg_crossed_Design_2 HC | HCJ7 | CDelta | CJ'4G1 | FcG1 |
| SEQ ID NO: 238 dg_crossed_Design_2 LC SEQ ID NO: 237 | SEQ ID NO: 124 LCJ7 SEQ ID NO: 126 | SEQ ID NO: 332 CGamma SEQ ID NO: 340 | SEQ ID NO: 127 | SEQ ID NO: 302 |

TABLE 19

Sequences for exemplary chimeric constant regions

| Template Designs CAlpha/ CBeta | Chain Type | SEQ ID NO | Sequences |
|---|---|---|---|
| Design_1 (IgG1) normal | LC | 176 | LCJ1-CAlpha(T49C) KRTVAAPDPAVYQLRDSKSSDKSVCLFTDFDSQTNVSQSKDSDVYITDKCVLDMRSMDFKSN SAVAWSNKSDFACANAFNNSIIPEDTFFPSPESS |
| | HC | 177 | HCJ1-CBeta(S56C)-CJ' 1G1-Fc(G1) SSASKNVFPPEVAVFEPSEAEISHTQKATLVCLATGFYPDHVELSWWVNGKEVHSGVCTDPQ PLKEQPALNDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design_2 (IgG1) normal | LC | 178 | LCJ2-CAlpha(T49C) KPDIQNPDPAVYQLRDSKSSDKSVCLFTDFDSQTNVSQSKDSDVYITDKCVLDMRSMDFKSN SAVAWSNKSDFACANAFNNSIIPEDTFFPSPESS |
| | HC | 179 | HCJ2-CBeta(S56C)-CJ' 1G1- Fc(G1) LEDLKNVFPPEVAVFEPSEAEISHTQKATLVCLATGFYPDHVELSWWVNGKEVHSGVCTDPQ PLKEQPALNDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |

TABLE 19-continued

Sequences for exemplary chimeric constant regions

| Design | Chain | SEQ ID | Name | Sequence |
|---|---|---|---|---|
| Design_5 (IgG1) normal | LC | 176 | LCJ1-CAlpha(T49C) | KRTVAAPDPAVYQLRDSKSSDKSVCLFTDFDSQTNVSQSKDSDVYITDKCVLDMRSMDFKSN SAVAWSNKSDFACANAFNNSIIPEDTFFPSPESS |
| | HC | 180 | HCJ1-CBeta(S56C)(FG-DE+)-CJ' 1G1-Fc(G1) | SSASKNVFPPEVAVFEPSEAEISHTQKATLVCLATGFYPDHVELSWWVNGKEVHSGVCTDPQ PLKEQPALNDSRYALSSRLRVSATFWQNPRNHFRCQVQFYPSNQIVSAEAWGRASDKTHTCP PCPAPEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| Design_6 (IgG1) normal | LC | 178 | LCJ2-CAlpha(T49C) | KPDIQNPDPAVYQLRDSKSSDKSVCLFTDFDSQTNVSQSKDSDVYITDKCVLDMRSMDFKSN SAVAWSNKSDFACANAFNNSIIPEDTFFPSPESS |
| | HC | 181 | HCJ2-CBeta(S56C)(FG-DE+)-CJ' 1G1-Fc(G1) | LEDLKNVFPPEVAVFEPSEAEISHTQKATLVCLATGFYPDHVELSWWVNGKEVHSGVCTDPQ PLKEQPALNDSRYALSSRLRVSATFWQNPRNHFRCQVQFYPSNQIVSAEAWGRASDKTHTCP PCPAPEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQVYTL PPSREEMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| Design_6a (IgG1) normal | LC | 178 | LCJ2-CAlpha(T49C) | KPDIQNPDPAVYQLRDSKSSDKSVCLFTDFDSQTNVSQSKDSDVYITDKCVLDMRSMDFKSN SAVAWSNKSDFACANAFNNSIIPEDTFFPSPESS |
| | HC | 182 | HCJ2-CBeta(S56C)(FG-DE+)-CJ' 1G1-Fc(G1) | LEDLKNVFPPEVAVFEPSEAEISHTQKATLVCLATGFYPDHVELSWWVNGKEVHSGVCTDPQ PLKEQSGRYALSSRLRVSATFWQNPRNHFRCQVQFYPSNQIVSAEAWGRASDKTHTCPPCPA PEAAGGPSVFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQVYTLPPSR EEMTKNQVSLTCLVKGFYPSDIAVEWESNGQPENNYKTTPPVLDSDGSFFLYSKLTVDKSRW QQGNVFSCSVMHEALHNHYTQKSLSLSPGK |
| Design_3 (IgG1) crossed | LC | 183 | LCJ3-CBeta(S56C) | KLEDLKNVFPPEVAVFEPSEAEISHTQKATLVCLATGFYPDHVELSWWVNGKEVHSGVCTDP QPLKEQPALNDSRYALSSRLRVSATFWQNPRNHFRCQVQFYGLSENDEWTQDRAKPVTQIVS AEAWGRA |
| | HC | 184 | HCJ2-CBeta(S56C)(FG-DE-)-CJ' 1G1-Fc(G1) | SSASIQNPDPAVYQLRDSKSSDKSVCLFTDFDSQTNVSQSKDSDVYITDKCVLDMRSMDFKS NSAVAWSNKSDFACANAFNNSIIPEDTFFPSPESSSDKTHTCPPCPAPEAAGGPSVFLFPPK PKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSVMHEAL HNHYTQKSLSLSPGK |
| Design_4 (IgG1) crossed | LC | 183 | LCJ4-CBeta(S56C) | KLEDLKNVFPPEVAVFEPSEAEISHTQKATLVCLATGFYPDHVELSWWVNGKEVHSGVCTDP QPLKEQPALNDSRYALSSRLRVSATFWQNPRNHFRCQVQFYGLSENDEWTQDRAKPVTQIVS AEAWGRA |
| | HC | 185 | HCJ4-CAlpha(T49C)-CJ'2G1-Fc(G1) | SSPDIQNPDPAVYQLRDSKSSDKSVCLFTDFDSQTNVSQSKDSDVYITDKCVLDMRSMDFKS NSAVAWSNKSDFACANAFNNSIIPEDTFFPSPESSSDKTHTCPPCPAPEAAGGPSVFLFPPK PKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSVMHEAL HNHYTQKSLSLSPGK |
| Design_7 (IgG1) crossed | LC | 186 | LCJ3-CBeta(S56C)(FG-DE+) | KLEDLKNVFPPEVAVFEPSEAEISHTQKATLVCLATGFYPDHVELSWWVNGKEVHSGVCTDP QPLKEQPALNDSRYALSSRLRVSATFWQNPRNHFRCQVQFYPSNQIVSAEAWGRA |
| | HC | 184 | HCJ3-CAlpha(T49C)-CJ'2G1-Fc(G1) | SSASIQNPDPAVYQLRDSKSSDKSVCLFTDFDSQTNVSQSKDSDVYITDKCVLDMRSMDFKS NSAVAWSNKSDFACANAFNNSIIPEDTFFPSPESSSDKTHTCPPCPAPEAAGGPSVFLFPPK PKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSVMHEAL HNHYTQKSLSLSPGK |
| Design_8 (IgG1) crossed | LC | 186 | LCJ4-CBeta(S56C)(FG-DE+) | KLEDLKNVFPPEVAVFEPSEAEISHTQKATLVCLATGFYPDHVELSWWVNGKEVHSGVCTDP QPLKEQPALNDSRYALSSRLRVSATFWQNPRNHFRCQVQFYPSNQIVSAEAWGRA |
| | HC | 185 | HCJ4-CAlpha(T49C)-CJ'2G1-Fc(G1) | SSPDIQNPDPAVYQLRDSKSSDKSVCLFTDFDSQTNVSQSKDSDVYITDKCVLDMRSMDFKS NSAVAWSNKSDFACANAFNNSIIPEDTFFPSPESSSDKTHTCPPCPAPEAAGGPSVFLFPPK PKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSVMHEAL HNHYTQKSLSLSPGK |
| Design 2-QQQQ (IgG1) | LC | 187 | LCJ2-CAlpha(T49C)(N34Q+N68Q+N79Q) | KPDIQNPDPAVYQLRDSKSSDKSVCLFTDFDSQTQVSQSKDSDVYITDKCVLDMRSMDFKSN SAVAWSQKSDFACANAFQNSIIPEDTFFPSPESS |
| | HC | 188 | HCJ2-CBeta(S56C)(N69Q)-CJ' 1G1-Fc(G1) | LEDLKNVFPPEVAVFEPSEAEISHTQKATLVCLATGFYPDHVELSWWVNGKEVHSGVCTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |

TABLE 19-continued

Sequences for exemplary chimeric constant regions

| | Chain | SEQ ID NO | Name | Sequences |
|---|---|---|---|---|
| Design 2-AAAA (IgG1) | LC | 189 | LCJ2-CAlpha(T49C) (N34A + N68A + N79A) | KPDIQNPDPAVYQLRDSKSSDKSVCLFTDFDSQTAVSQSKDSDVYITDKCVLDMRSMDFKSN SAVAWSAKSDFACANAFANSIIPEDTFFPSPESS |
| | HC | 190 | HCJ2-CBeta(S56C) (N69A)-CJ' 1G1- Fc(G1) | LEDLKNVFPPEVAVFEPSEAEISHTQKATLVCLATGFYPDHVELSWWVNGKEVHSGVCTDPQ PLKEQPALADSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design 2-QSKE (IgG1) | LC | 191 | LCJ2-CAlpha(T49C) (N34Q+ N68S+ N79K) | KPDIQNPDPAVYQLRDSKSSDKSVCLFTDFDSQTAVSQSKDSDVYITDKCVLDMRSMDFKSN SAVAWSSKSDFACANAFKNSIIPEDTFFPSPESS |
| | HC | 192 | HCJ2-CBeta(S56C) (N69E)-CJ' 1G1- Fc(G1) | LEDLKNVFPPEVAVFEPSEAEISHTQKATLVCLATGFYPDHVELSWWVNGKEVHSGVCTDPQ PLKEQPALEDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design 2-ASKE (IgG1) | LC | 193 | LCJ2-CAlpha(T49C) (N34A + N68S+ N79K) | KPDIQNPDPAVYQLRDSKSSDKSVCLFTDFDSQTAVSQSKDSDVYITDKCVLDMRSMDFKSN SAVAWSSKSDFACANAFKNSIIPEDTFFPSPESS |
| | HC | 192 | HCJ2-CBeta(S56C)(N 69E)-CJ' 1G1 - Fc(G1) | LEDLKNVFPPEVAVFEPSEAEISHTQKATLVCLATGFYPDHVELSWWVNGKEVHSGVCTDPQ PLKEQPALEDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design_2-QQQQQ (IgG1) | LC | 194 | LCJ2-CAlpha(T49C) (N34Q+ N68Q+ N79Q+ N61Q) | KPDIQNPDPAVYQLRDSKSSDKSVCLFTDFDSQTAVSQSKDSDVYITDKCVLDMRSMDFKSQ SAVAWSQKSDFACANAFQNSIIPEDTFFPSPESS |
| | HC | 195 | HCJ2-CBeta(S56C) (N69Q)-CJ' 1G1- Fc(G1) | LEDLKNVFPPEVAVFEPSEAEISHTQKATLVCLATGFYPDHVELSWWVNGKEVHSGVCTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design 2-QQQQ (IgG4) | LC | 187 | | KPDIQNPDPAVYQLRDSKSSDKSVCLFTDFDSQTAVSQSKDSDVYITDKCVLDMRSMDFKSN SAVAWSQKSDFACANAFQNSIIPEDTFFPSPESS |
| | HC | 196 | HCJ2-CBeta(S56C)-CJ' 1G4- Fc(G4) | LEDLKNVFPPEVAVFEPSEAEISHTQKATLVCLATGFYPDHVELSWWVNGKEVHSGVCTDPQ PLKEQPALQDSRYALSSRLRVSATFWQNPRNHFRCQVQFYGLSENDEWTQDRAKPVTQIVSA EAWGRYGPPCPPCPAPEFLGGPSVFLFPPKPKDTLMISRTPEVTCVVVDVSQEDPEVQFNWY VDGVEVHNAKTKPREEQFNSTYRVVSVLTVLHQDWLNGKEYKCKVSNKGLPSSIEKTISKAK GQPREPQVYTLPPSQEEMTKNQVSLTCLVKGFYPSDIAVEWESNGQPENNYKTTPPVLDSDG SFFLYSRLTVDKSRWQEGNVFSCSVMHEALHNHYTQKSLSLSLGK |

| PreAlpha-Beta Designs | Chain Name | SEQ ID NO | | Sequences |
|---|---|---|---|---|
| Design_1_Pre_TCR_Conjunction'1 | LC | 197 | LCJB-CPreAlpha(N50Q) | KPTGVGGTPFPSLAPPIMLLVDGKQQMVVVCLVLDVAPPGLDSPIWFSAGQGSALDAFTYGP SPATDGTWTNLAHLSLPSEELASWEPLVCHTGPGAEGHSRSTQPMHLSGEASTART |
| | HC | 198 | HCJB-CBeta(N69Q)-CJ' 1G1- Fc(G1) | LEDLKNVFPPEVAVFEPSEAEISHTQKATLVCLATGFYPDHVELSWWVNGKEVHSGVSTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design_2_Pre_TCR_Conjunction'1_Cys10 | LC | 199 | LCJB-CPreAlpha(Y59C)(N50Q) | KPTGVGGTPFPSLAPPIMLLVDGKQQMVVVCLVLDVAPPGLDSPIWFSAGQGSALDAFTCGP SPATDGTWTNLAHLSLPSEELASWEPLVCHTGPGAEGHSRSTQPMHLSGEASTART |
| | HC | 200 | HCJB-CBeta(S76C)(N69Q)-CJ' 1G1- Fc(G1) | LEDLKNVFPPEVAVFEPSEAEISHTQKATLVCLATGFYPDHVELSWWVNGKEVHSGVSTDPQ PLKEQPALQDSRYALCSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |

TABLE 19-continued

Sequences for exemplary chimeric constant regions

| | | | |
|---|---|---|---|
| Design_3_Pr e_TCR_Con junction'1_ Cys11 | LC | 201 VL(CD3)- LCJB- CPreAlpha (A13C) (N50Q) | KPTGVGGTPFPSLCPPIMLLVDGKQQMVVVCLVLDVAPPGLDSPIWFSAGQGSALDAFTYGP SPATDGTWTNLAHLSLPSEELASWEPLVCHTGPGAEGHSRSTQPMHLSGEASTART |
| | HC | 202 HCJB- CBeta(F13C) (N69Q)- CJ' 1G1- Fc(G1) | LEDLKNVFPPEVAVCEPSEAEISHTQKATLVCLATGFYPDHVELSWWVNGKEVHSGVSTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design_4_Pr e_TCR_Con junction'1_ Cys12 | LC | 201 VL(CD3)- LCJB- CPreAlpha (A13C) (N50Q) | KPTGVGGTPFPSLCPPIMLLVDGKQQMVVVCLVLDVAPPGLDSPIWFSAGQGSALDAFTYGP SPATDGTWTNLAHLSLPSEELASWEPLVCHTGPGAEGHSRSTQPMHLSGEASTART |
| | HC | 203 HCJB- CBeta(S16C) (N69Q)- CJ' 1G1- Fc(G1) | LEDLKNVFPPEVAVFEPCEAEISHTQKATLVCLATGFYPDHVELSWWVNGKEVHSGVSTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design_5_Pr e_TCR_Con junction'1_ Cys13 | LC | 204 VL(CD3)- LCJB- CPreAlpha (S11C) (N50Q) | KPTGVGGTPFPCLAPPIMLLVDGKQQMVVVCLVLDVAPPGLDSPIWFSAGQGSALDAFTYGP SPATDGTWTNLAHLSLPSEELASWEPLVCHTGPGAEGHSRSTQPMHLSGEASTART |
| | HC | 203 HCJB- CBeta(S16C) (N69Q)- CJ' 1G1- Fc(G1) | LEDLKNVFPPEVAVFEPCEAEISHTQKATLVCLATGFYPDHVELSWWVNGKEVHSGVSTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design_6_Pr e_TCR_Con junction'1_ Cys14 | LC | 204 VL(CD3)- LCJB- CPreAlpha (S11C) (N50Q) | KPTGVGGTPFPCLAPPIMLLVDGKQQMVVVCLVLDVAPPGLDSPIWFSAGQGSALDAFTYGP SPATDGTWTNLAHLSLPSEELASWEPLVCHTGPGAEGHSRSTQPMHLSGEASTART |
| | HC | 205 HCJB- CBeta(A18C) (N69Q)- CJ' 1G1- Fc(G1) | LEDLKNVFPPEVAVFEPSECEISHTQKATLVCLATGFYPDHVELSWWVNGKEVHSGVSTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design_7_Pr e_TCR_Con junction'1_ Cys15 | LC | 204 VL(CD3)- LCJB- CPreAlpha (S11C) (N50Q) | KPTGVGGTPFPCLAPPIMLLVDGKQQMVVVCLVLDVAPPGLDSPIWFSAGQGSALDAFTYGP SPATDGTWTNLAHLSLPSEELASWEPLVCHTGPGAEGHSRSTQPMHLSGEASTART |
| | HC | 206 HCJB- CBeta(E19C) (N69Q)- CJ' 1G1- Fc(G1) | LEDLKNVFPPEVAVFEPSEACISHTQKATLVCLATGFYPDHVELSWWVNGKEVHSGVSTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design_8_Pr e_TCR_Con junction'1_ Cys1_4L4T 1 | LC | 207 VL(CD3)- LCJB- CPreAlpha (S62C) (N50Q) | KPTGVGGTPFPSLAPPIMLLVDGKQQMVVVCLVLDVAPPGLDSPIWFSAGQGSALDAFTYGP CPATDGTWTNLAHLSLPSEELASWEPLVCHTGPGAEGHSRSTQPMHLSGEASTART |
| | HC | 208 HCJB- CBeta(S56C) (N69Q)- CJ' 1G1- Fc(G1) | LEDLKNVFPPEVAVFEPSEAEISHTQKATLVCLATGFYPDHVELSWWVNGKEVHSGVCTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| Design_9_Pr e_TCR_Con junction'1_ Cys2_4L4T 2 | LC | 209 VL(CD3)- LCJB- CPreAlpha (T65C) (N50Q) | KPTGVGGTPFPSLAPPIMLLVDGKQQMVVVCLVLDVAPPGLDSPIWFSAGQGSALDAFTYGP SPACDGTWTNLAHLSLPSEELASWEPLVCHTGPGAEGHSRSTQPMHLSGEASTART |
| | HC | 208 HCJB- CBeta(S56C) (N69Q)- CJ' 1G1- Fc(G1) | LEDLKNVFPPEVAVFEPSEAEISHTQKATLVCLATGFYPDHVELSWWVNGKEVHSGVCTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |

TABLE 19-continued

Sequences for exemplary chimeric constant regions

| | | | |
|---|---|---|---|
| Design_10_P re_TCR_Co njunc- tion'1_ Cys4 | LC | 210 VL(CD3)- LCJB- CPreAlpha (I16C)(N50Q) | KPTGVGGTPFPSLAPPCMLLVDKQQMVVVCLVLDVAPPGLDSPIWFSAGQGSALDAFTYGP SPATDGTWTNLAHLSLPSEELASWEPLVCHTGPGAEGHSRSTQPMHLSGEASTART |
| | HC | 211 HCJB- CBeta(A11C) (N69Q)- CJ' 1G1- Fc(G1) | LEDLKNVFPPEVCVFEPSEAEISHTQKATLVCLATGFYPDHVELSWWVNGKEVHSGVSTDPQ PLKEQPALQDSRYALSSRLRVSATFWQNPRNHFRCQVQFYGLSENDEWTQDRAKPVTQIVSA EAWGRASDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK |
| PreTCR_De sign5_crosse d_1 | Light | 212 VL(CD3)- HCJB- CBeta (N69Q, S16C)- CJ' 1G | KLEDLKNVFPPEVAVFEPCEAEISHTQKATLVCLATGFYPDHVELSWWVNGKEVHSGVSTDPQPLKEQ PALQDSRYALSSRLRVSATFWQNPRNHFRCQVQFYGLSENDEWTQDRAKPVTQIVSAEAWGRA |
| | Heav y (Conj unctio n more antibo dy) | 213 HCJC- CPreAlpha (S11C, N50Q) - CJ'2G1- Fc | SSASGVGGTPFPCLAPPIMLLVDKQQMVVVCLVLDVAPPGLDSPIWFSAGQGSALDAFTYGPSPATD GTWTNLAHLSLPSEELASWEPLVCHTGPGAEGHSRSTQPMHLSGEASTARTSDKTHTCPPCPAPEAAG GPSVFLFPPKPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGNVFSCSVMHEALHNHYTQKS LSLSPGK |
| Pre_TCR_De sign_5_cross ed_2 | Light | 212 VL(CD3)- HCJB- CBeta (N69Q, S16C)- CJ' 1G | KLEDLKNVFPPEVAVFEPCEAEISHTQKATLVCLATGFYPDHVELSWWVNGKEVHSGVSTDPQPLKEQ PALQDSRYALSSRLRVSATFWQNPRNHFRCQVQFYGLSENDEWTQDRAKPVTQIVSAEAWGRA |
| | Heav y (Conj unctio n more PreT CR) | 214 HCJD- CPreAlpha (S11) -CJ'2G1- Fc | SSPTGVGGTPFPCLAPPIMLLVDKQQMVVVCLVLDVAPPGLDSPIWFSAGQGSALDAFTYGPSPATD GTWTNLAHLSLPSEELASWEPLVCHTGPGAEGHSRSTQPMHLSGEASTARTSDKTHTCPPCPAPEAAG GPSVFLFPPKPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGNVFSCSVMHEALHNHYTQKS LSLSPGK |
| Pre_TCR_De sign_6_cross ed_1 | Light | 215 VL(CD3)- LCJC- CBeta (A18C, N69Q) | KLEDLKNVFPPEVAVFEPSECEISHTQKATLVCLATGFYPDHVELSWWVNGKEVHSGVSTDPQPLKEQ PALQDSRYALSSRLRVSATFWQNPRNHFRCQVQFYGLSENDEWTQDRAKPVTQIVSAEAWGRA |
| | Heav y (Conj unctio n more antibo dy) | 213 | |
| Pre_TCR_De sign_6_cross ed-2 | Light | 215 | KLEDLKNVFPPEVAVFEPSECEISHTQKATLVCLATGFYPDHVELSWWVNGKEVHSGVSTDPQPLKEQ PALQDSRYALSSRLRVSATFWQNPRNHFRCQVQFYGLSENDEWTQDRAKPVTQIVSAEAWGRA |
| | Heav y (Conj unctio n more TCR) | 214 | |

| Delta- Gamma Designs | Chain Name | SEQ ID NO | Sequences |
|---|---|---|---|
| dg_Design_2 no Glyco | LC | 215 VL(CD3)-LCJ5- CDelta (N16Q+ N79Q) | EPRSQPHTKPSVFVMKQGTNVACLVKEFYPKDIRINLVSSKKITEFDPAIVISPSGKYNAVK LGKYEDSNSVTCSVQHDQKTVHSTDFE |
| | HC | 216 HCJ5-CGamma- CJ'3G1- Fc(G1) (N65Q) | TDKQLDADVSPKPTIFLPSIAETKLQKAGTYLCLLEKFFPDVIKIHWQEKKSNTILGSQEGN TMKTQDTYMKFSWLTVPEESLDKEHRCIVRHENNKNGVDQEIIFPPIKSDKTHTCPPCPAPE AAGGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSREE MTKNQVSLTCLVKGFYPSDIAVEWESNGQPENNYKTTPPVLDSDGSFFLYSKLTVDKSRWQQ GNVFSCSVMHEALHNHYTQKSLSLSPGK |

TABLE 19-continued

Sequences for exemplary chimeric constant regions

| | | | |
|---|---|---|---|
| dg_Design_2_LC_hypeCys1_no_Glyco | LC | 217 VL(CD3)-LCJ5-CDelta (N16C) (N79Q) | EPRSQPHTKPSVFVMKCGTNVACLVKEFYPKDIRINLVSSKKITEFDPAIVISPSGKYNAVK<br>LGKYEDSNSVTCSVQHDQKTVHSTDFE |
| | HC | 218 HCJ5-CGamma (T12C) (N65Q)-CJ'3G1-Fc(G1) | TDKQLDADVSPKPCIFLPSIAETKLQKAGTYLCLLEKFFPDVIKIHWQEKKSNTILGSQEGN<br>TMKTQDTYMKFSWLTVPEESLDKEHRCIVRHENNKNGVDQEIIFPPIKSDKTHTCPPCPAPE<br>AAGGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQ<br>GNVFSCSVMHEALHNHYTQKSLSLSPGK |
| dg_Design_2_LC_hypeCys2_no_Glyco | LC | 219 VL(CD3)-LCJ5-CDelta (V50C) (N16Q+ N79Q) | EPRSQPHTKPSVFVMKQGTNVACLVKEFYPKDIRINLVSSKKITEFDPAICISPSGKYNAVK<br>LGKYEDSNSVTCSVQHDQKTVHSTDFE |
| | HC | 220 HCJ5-CGamma (Q57C) (N65Q)-CJ'3G1-Fc(G1) | TDKQLDADVSPKPTIFLPSIAETKLQKAGTYLCLLEKFFPDVIKIHWQEKKSNTILGSCEGN<br>TMKTQDTYMKFSWLTVPEESLDKEHRCIVRHENNKNGVDQEIIFPPIKSDKTHTCPPCPAPE<br>AAGGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQ<br>GNVFSCSVMHEALHNHYTQKSLSLSPGK |
| dg_Design_2_LC_hypeCys3_no_Glyco | LC | 221 VL(CD3)-LCJ5-CDelta (D46C) (N16Q+ N79Q) | EPRSQPHTKPSVFVMKQGTNVACLVKEFYPKDIRINLVSSKKITEFCPAIVISPSGKYNAVK<br>LGKYEDSNSVTCSVQHDQKTVHSTDFE |
| | HC | 222 HCJ5-CGamma (M62C) (N65Q)-CJ'3G1-Fc(G1) | TDKQLDADVSPKPTIFLPSIAETKLQKAGTYLCLLEKFFPDVIKIHWQEKKSNTILGSQEGN<br>TCKTQDTYMKFSWLTVPEESLDKEHRCIVRHENNKNGVDQEIIFPPIKSDKTHTCPPCPAPE<br>AAGGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQ<br>GNVFSCSVMHEALHNHYTQKSLSLSPGK |
| dg_Design_2_LC_Cys2_no_Glyco | LC | 223 VL(CD3)-LCJ5-CDelta (F12C) (N16Q+ N79Q) | EPRSQPHTKPSVFVMKQGTNVACLVKEFYPKDIRINLVSSKKITEFDPAIVISPSGKYNAVK<br>LGKYEDSNSVTCSVQHDQKTVHSTDFE |
| | HC | 224 HCJ5-CGamma (S17C) (N65Q)-CJ'3G1-Fc(G1) | TDKQLDADVSPKPTIFLPCIAETKLQKAGTYLCLLEKFFPDVIKIHWQEKKSNTILGSQEGN<br>TMKTQDTYMKFSWLTVPEESLDKEHRCIVRHENNKNGVDQEIIFPPIKSDKTHTCPPCPAPE<br>AAGGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQ<br>GNVFSCSVMHEALHNHYTQKSLSLSPGK |
| dg_Design_2_LC_Cys1_no_Glyco | LC | 225 VL(CD3)-LCJ5-CDelta (M14C) (N16Q+ N79Q) | EPRSQPHTKPSVFVCKQGTNVACLVKEFYPKDIRINLVSSKKITEFDPAIVISPSGKYNAVK<br>LGKYEDSNSVTCSVQHDQKTVHSTDFE |
| | HC | 226 HCJ5-CGamma (F14C) (N65Q)-CJ'3G1-Fc(G1) | TDKQLDADVSPKPTICLPSIAETKLQKAGTYLCLLEKFFPDVIKIHWQEKKSNTILGSQEGN<br>TMKTQDTYMKFSWLTVPEESLDKEHRCIVRHENNKNGVDQEIIFPPIKSDKTHTCPPCPAPE<br>AAGGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQ<br>GNVFSCSVMHEALHNHYTQKSLSLSPGK |
| dg_Design_2_LC_Cys3_no_Glyco | LC | 223 VL(CD3)-LCJ5-CDelta (F12C) (N16Q+ N79Q) | EPRSQPHTKPSVCVMKQGTNVACLVKEFYPKDIRINLVSSKKITEFDPAIVISPSGKYNAVK<br>LGKYEDSNSVTCSVQHDQKTVHSTDFE |
| | HC | 227 HCJ5-CGamma (E20C) (N65Q)-CJ'3G1-Fc(G1) | TDKQLDADVSPKPTIFLPSIACTKLQKAGTYLCLLEKFFPDVIKIHWQEKKSNTILGSQEGN<br>TMKTQDTYMKFSWLTVPEESLDKEHRCIVRHENNKNGVDQEIIFPPIKSDKTHTCPPCPAPE<br>AAGGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQ<br>GNVFSCSVMHEALHNHYTQKSLSLSPGK |
| dg_Design_2_LC_Cys4_no_Glyco | LC | 228 VL(CD3)-LCJ5-CDelta (F87C) (N16Q+ N79Q) | EPRSQPHTKPSVFVMKQGTNVACLVKEFYPKDIRINLVSSKKITEFDPAIVISPSGKYNAVK<br>LGKYEDSNSVTCSVQHDQKTVHSTDCE |
| | HC | 229 HCJ5-CGamma (A19C) (N65Q)-CJ'3G1-Fc(G1) | TDKQLDADVSPKPTIFLPSICETKLQKAGTYLCLLEKFFPDVIKIHWQEKKSNTILGSQEGN<br>TMKTQDTYMKFSWLTVPEESLDKEHRCIVRHENNKNGVDQEIIFPPIKSDKTHTCPPCPAPE<br>AAGGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQ<br>GNVFSCSVMHEALHNHYTQKSLSLSPGK |

TABLE 19-continued

Sequences for exemplary chimeric constant regions

| | | | |
|---|---|---|---|
| dg_Design_2 _Cys5_no_G lyco | LC | 230 VL(CD3)-LCJ5-CDelta (E88C) (N16Q+ N79Q) | EPRSQPHTKPSVFVMKQGTNVACLVKEFYPKDIRINLVSSKKITEFDPAIVISPSGKYNAVK LGKYEDSNSVTCSVQHDQKTVHSTDFC |
| | HC | 229 HCJ5-CGamma (A19C) (N65Q)-CJ'3G1- Fc(G1) | TDKQLDADVSPKPTIFLPSICETKLQKAGTYLCLLEKFFPDVIKIHWQEKKSNTILGSQEGN TMKTQDTYMKFSWLTVPEESLDKEHRCIVRHENNKNGVDQEIIFPPIKSDKTHTCPPCPAPE AAGGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSREE MTKNQVSLTCLVKGFYPSDIAVEWESNGQPENNYKTTPPVLDSDGSFFLYSKLTVDKSRWQQ GNVFSCSVMHEALHNHYTQKSLSLSPGK |
| dg_Design_2 | LC | 231 VL(CD3)-LCJ5-CDelta | EPRSQPHTKPSVFVMKNGTNVACLVKEFYPKDIRINLVSSKKITEFDPAIVISPSGKYNAVK LGKYEDSNSVTCSVQHDNKTVHSTDFE |
| | HC | 232 HCJ5-CGamma-CJ'3G1- Fc(G1) | TDKQLDADVSPKPTIFLPSIAETKLQKAGTYLCLLEKFFPDVIKIHWQEKKSNTILGSQEGN TMKTNDTYMKFSWLTVPEESLDKEHRCIVRHENNKNGVDQEIIFPPIKSDKTHTCPPCPAPE AAGGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSREE MTKNQVSLTCLVKGFYPSDIAVEWESNGQPENNYKTTPPVLDSDGSFFLYSKLTVDKSRWQQ GNVFSCSVMHEALHNHYTQKSLSLSPGK |
| dg_Design_1 | LC | 233 VL(CD3)-LCJ4-CDelta | KPRSQPHTKPSVFVMKNGTNVACLVKEFYPKDIRINLVSSKKITEFDPAIVISPSGKYNAVK LGKYEDSNSVTCSVQHDNKTVHSTDFE |
| | HC | 234 HCJ4-CGamma-CJ'3G1- Fc(G1) | SSASLDADVSPKPTIFLPSIAETKLQKAGTYLCLLEKFFPDVIKIHWQEKKSNTILGSQEGN TMKTNDTYMKFSWLTVPEESLDKEHRCIVRHENNKNGVDQEIIFPPIKSDKTHTCPPCPAPE AAGGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSREE MTKNQVSLTCLVKGFYPSDIAVEWESNGQPENNYKTTPPVLDSDGSFFLYSKLTVDKSRWQQ GNVFSCSVMHEALHNHYTQKSLSLSPGK |
| dg_crossed_ Design_1 | LC | 235 VL(CD3)-LCJ6-CGamma | KDKQLDADVSPKPTIFLPSIAETKLQKAGTYLCLLEKFFPDVIKIHWQEKKSNTILGSCEGN TMKTQDTYMKFSWLTVPEESLDKEHRCIVRHENNKNGVDQEIIFPPIKTDVITMD |
| | HC | 236 HCJ6- CDelta-CJ'4G1- Fc(G1) | SSRSQPHTKP<u>SVFVMKQGTNVACLVKEFYPKDIRINLVSSKKITEFDPAICISPSGKYNAVK LGKYEDSNSVTCSVQHDQKTVHSTDEPKSCDKTHTCPPCPAPEAAGGPSVFLFPPKPKDTLM</u> ISRTPEVTCVVVDVSHEDPEVKFNWYVDGVEVHNAKTKPREEQYNSTYRVVSVLTVLHQDWL NGKEYKCKVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMHEALHNHYTQ KSLSLSPGK |
| dg_crossed_ Design_2 | LC | 237 VL(CD3)-LCJ7-CGamma | KDKQLDADVSPKPTIFLPSIAETKLQKAGTYLCLLEKFFPDVIKIHWQEKKSNTILGSCEGN TMKTQDTYMKFSWLTVPEESLDKEHRCIVRHENNKNGVDQEIIFPPIKTDVITMD |
| | HC | 238 HCJ7- CDelta-CJ'4G1- Fc(G1) | EPRSQPHTKP<u>SVFVMKQGTNVACLVKEFYPKDIRINLVSSKKITEFDPAICISPSGKYNAVK LGKYEDSNSVTCSVQHDQKTVHSTDEPKSCDKTHTCPPCPAPEAAGGPSVFLFPPKPKDTLM</u> ISRTPEVTCVVVDVSHEDPEVKFNWYVDGVEVHNAKTKPREEQYNSTYRVVSVLTVLHQDWL NGKEYKCKVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMHEALHNHYTQ KSLSLSPGK |

TABLE 20

Sequences for exemplary polypeptide complexes

| Alpha-Beta Designs | Chain Name | SEQ ID No | | Sequences |
|---|---|---|---|---|
| T3-Design_1 (IgG1) normal | LC | 1 | VL(CD3)-LCJ1-CAlpha(T49C) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IKRTVAAPDPAVYQLRDSKSSDKSVCLFTDFDSQTNVSQSKDSDVYITDKCVLDM RSMDFKSNSAVAWSNKSDFACANAFNNSIIPEDTFFPSPESS |
| | HC | 2 | VH(CD3)-HCJ1-CBeta(S56C)-CJ' 1G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVSSASKNVFPPEVAVFEPSEAEISHTQKATLVCLATGFYPDHVELSWWV NGKEVHSGVCTDPQPLKEQPALNDSRYALSSRLRVSATFWQNPRNHFRCQVQFYG LSENDEWTQDRAKPVTQIVSAEAWGRASDKTHTCPPCPAPEAAGGPSVFLFPPKP KDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREE MTKNQVSLTCLVKGFYPSDIAVEWESNGQPENNYKTTPPVLDSDGSFFLYSKLTV DKSRWQQGNVFSCSVMHEALHNHYTQKSLSLSPGK |
| T3-Design_2 (IgG1) normal | LC | 3 | VL(CD3)-LCJ2-CAlpha(T49C) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IKPDIQNPDPAVYQLRDSKSSDKSVCLFTDFDSQTNVSQSKDSDVYITDKCVLDM RSMDFKSNSAVAWSNKSDFACANAFNNSIIPEDTFFPSPESS |
| | HC | 4 | VH(CD3)-HCJ2-CBeta(S56C)- | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVLEDLKNVFPPEVAVFEPSEAEISHTQKATLVCLATGFYPDHVELSWWV |

TABLE 20-continued

Sequences for exemplary polypeptide complexes

| | | | | |
|---|---|---|---|---|
| | | | CJ' 1G1-Fc(G1) | NGKEVHSGVCTDPQPLKEQPALNDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| T3-Design_5<br>(IgG1)<br>normal | LC | 1 | VL(CD3)-<br>LCJ1-<br>CAlpha(T49C) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKRTVAAPDPAVYQLRDSKSSDKSVCLFTDFDSQTNVSQSKDSDVYITDKCVLDM<br>RSMDFKSNSAVAWSNKSDFACANAFNNSIIPEDTFFPSPESS |
| | HC | 5 | VH(CD3) -<br>HCJ1-<br>CBeta(S56C)(F<br>G-DE+)-<br>CJ' 1G1-<br>Fc(G1) | QVQLVQSGAEVKKPGSSVKVSCKASGFAFTDYYIHWRQAPGQGLEWMGWISPGN<br>VNTKYNENFKGRVTITADKSTSTAYMELSSLRSEDTAVYYCARDGYSLYYFDYWG<br>QGTLVTVSSASKNVFPPEVAVFEPSEAEISHTQKATLVCLATGFYPDHVELSWWV<br>NGKEVHSGVCTDPQPLKEQPALNDSRYALSSRLRVSATFWQNPRNHFRCQVQFYP<br>SNQIVSAEAWGRASDKTHTCPPCPAPEAAGGPSVFLFPPKPKDTLMISRTPEVTC<br>VVVDVSHEDPEVKFNWYVDGVEVHNAKTKPREEQYNSTYRVVSVLTVLHQDWLNG<br>KEYKCKVSNKALPAPIEKTISKAKGQPREPQVYTLPPSREEMTKNQVSLTCLVKG<br>FYPSDIAVEWESNGQPENNYKTTPPVLDSDGSFFLYSKLTVDKSRWQQGNVFSCS<br>VMHEALHNHYTQKSLSLSPGK |
| T3-Design_6<br>(IgG1)<br>normal | LC | 3 | VL(CD3)-<br>LCJ2-<br>CAlpha(T49C) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPDIQNPDPAVYQLRDSKSSDKSVCLFTDFDSQTNVSQSKDSDVYITDKCVLDM<br>RSMDFKSNSAVAWSNKSDFACANAFNNSIIPEDTFFPSPESS |
| | HC | 6 | VH(CD3)-<br>HCJ2-<br>CBeta(S56C)(F<br>G-DE+)-<br>CJ' 1G1-Fc(G1) | QVQLVQSGAEVKKPGSSVKVSCKASGFAFTDYYIHWRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSEAEISHTQKATLVCLATGFYPDHVELSWWV<br>NGKEVHSGVCTDPQPLKEQPALNDSRYALSSRLRVSATFWQNPRNHFRCQVQFYP<br>SNQIVSAEAWGRASDKTHTCPPCPAPEAAGGPSVFLFPPKPKDTLMISRTPEVTC<br>VVVDVSHEDPEVKFNWYVDGVEVHNAKTKPREEQYNSTYRVVSVLTVLHQDWLNG<br>KEYKCKVSNKALPAPIEKTISKAKGQPREPQVYTLPPSREEMTKNQVSLTCLVKG<br>FYPSDIAVEWESNGQPENNYKTTPPVLDSDGSFFLYSKLTVDKSRWQQGNVFSCS<br>VMHEALHNHYTQKSLSLSPGK |
| T3-Design_6a<br>(IgG1)<br>normal | LC | 3 | VL(CD3)-<br>LCJ2-<br>CAlpha(T49C) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPDIQNPDPAVYQLRDSKSSDKSVCLFTDFDSQTNVSQSKDSDVYITDKCVLDM<br>RSMDFKSNSAVAWSNKSDFACANAFNNSIIPEDTFFPSPESS |
| | HC | 7 | VH(CD3)-<br>HCJ2-<br>CBeta(S56C)(F<br>G-DE-)-<br>CJ' 1G1-Fc(G1) | QVQLVQSGAEVKKPGSSVKVSCKASGFAFTDYYIHWRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSEAEISHTQKATLVCLATGFYPDHVELSWWV<br>NGKEVHSGVCTDPQPLKEQ--SG--RYALSSRLRVSATFWQNPRNHFRCQVQFYPSNQIVSAEAWGRASDKTHTCPPCPA<br>PEAAGGPSVFLFPPKPKDTLMISRTPEVTCVVVDVSHEDPEVKFNWYVDGVEVHN<br>AKTKPREEQYNSTYRVVSVLTVLHQDWLNGKEYKCKVSNKALPAPIEKTISKAKG<br>QPREPQVYTLPPSREEMTKNQVSLTCLVKGFYPSDIAVEWESNGQPENNYKTTPP<br>VLDSDGSFFLYSKLTVDKSRWQQGNVFSCSVMHEALHNHYTQKSLSLSPGK |
| T3-Design_3<br>(IgG1)<br>crossed | LC | 8 | VL(CD3)-<br>LCJ3-<br>CBeta(S56C) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKLEDLKNVFPPEVAVFEPSEAEISHTQKATLVCLATGFYPDHVELSWWVNGKEV<br>HSGVCTDPQPLKEQPALNDSRYALSSRLRVSATFWQNPRNHFRCQVQFYGLSEND<br>EWTQDRAKPVTQIVSAEAWGRA |
| | HC | 9 | VH(CD3)-<br>HCJ3-<br>CAlpha(T49C)-<br>CJ'2G1-Fc(G1) | QVQLVQSGAEVKKPGSSVKVSCKASGFAFTDYYIHWRQAPGQGLEWMGWISPGN<br>VNTKYNENFKGRVTITADKSTSTAYMELSSLRSEDTAVYYCARDGYSLYYFDYWG<br>QGTLVTVSSASIQNPDPAVYQLRDSKSSDKSVCLFTDFDSQTNVSQSKDSDVYIT<br>DKCVLDMRSMDFKSNSAVAWSNKSDFACANAFNNSIIPEDTFFPSPESSSDKTHT<br>CPPCPAPEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKALPAPIEKT<br>ISKAKGQPREPQVYTLPPSREEMTKNQVSLTCLVKGFYPSDIAVEWESNGQPENN<br>YKTTPPVLDSDGSFFLYSKLTVDKSRWQQGNVFSCSVMHEALHNHYTQKSLSLSP<br>GK |
| T3-Design_4<br>(IgG1)<br>crossed | LC | 8 | VL(CD3)-<br>LCJ4-<br>CBeta(S56C) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKLEDLKNVFPPEVAVFEPSEAEISHTQKATLVCLATGFYPDHVELSWWVNGKEV<br>HSGVCTDPQPLKEQPALNDSRYALSSRLRVSATFWQNPRNHFRCQVQFYGLSEND<br>EWTQDRAKPVTQIVSAEAWGRA |
| | HC | 10 | VH(CD3)-<br>HCJ4-<br>CAlpha(T49C)-<br>CJ'2G1-<br>Fc(G1) | QVQLVQSGAEVKKPGSSVKVSCKASGFAFTDYYIHWRQAPGQGLEWMGWISPGN<br>VNTKYNENFKGRVTITADKSTSTAYMELSSLRSEDTAVYYCARDGYSLYYFDYWG<br>QGTLVTVSSPDIQNPDPAVYQLRDSKSSDKSVCLFTDFDSQTNVSQSKDSDVYIT<br>DKCVLDMRSMDFKSNSAVAWSNKSDFACANAFNNSIIPEDTFFPSPESSSDKTHT<br>CPPCPAPEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKALPAPIEKT<br>ISKAKGQPREPQVYTLPPSREEMTKNQVSLTCLVKGFYPSDIAVEWESNGQPENN<br>YKTTPPVLDSDGSFFLYSKLTVDKSRWQQGNVFSCSVMHEALHNHYTQKSLSLSP<br>GK |

TABLE 20-continued

Sequences for exemplary polypeptide complexes

| | | | |
|---|---|---|---|
| T3-Design_7 (IgG1) crossed | LC | 11 VL(CD3)-LCJ3-CBeta(S56C)(FG-DE+) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKLEDLKNVFPPEVAVFEPSEAEISHTQKATLVCLATGFYPDHVELSWWVNGKEV<br>HSGVCTDPQPLKEQPALNDSRYALSSRLRVSATFWQNPRNHFRCQVQFYPSNQIV<br>SAEAWGRA |
| | HC | 9 VH(CD3)-HCJ3-CAlpha(T49C)-CJ'2G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVSSASIQNPDPAVYQLRDSKSSDKSVCLFTDFDSQTNVSQSKDSDVYIT<br>DKCVLDMRSMDFKSNSAVAWSNKSDFACANAFNNSIIPEDTFFPSPESSSDKTHT<br>CPPCPAPEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKALPAPIEKT<br>ISKAKGQPREPQVYTLPPSREEMTKNQVSLTCLVKGFYPSDIAVEWESNGQPENN<br>YKTTPPVLDSDGSFFLYSKLTVDKSRWQQGNVFSCSVMHEALHNHYTQKSLSLSP<br>GK |
| T3-Design_8 (IgG1) crossed | LC | 11 VL(CD3)-LCJ4-CBeta(S56C)(FlG-DE+) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKLEDLKNVFPPEVAVFEPSEAEISHTQKATLVCLATGFYPDHVELSWWVNGKEV<br>HSGVCTDPQPLKEQPALNDSRYALSSRLRVSATFWQNPRNHFRCQVQFYPSNQIV<br>SAEAWGRA |
| | HC | 10 VH(CD3)-HCJ4-CAlpha(T49C)-CJ'2G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVSSPDIQNPDPAVYQLRDSKSSDKSVCLFTDFDSQTNVSQSKDSDVYIT<br>DKCVLDMRSMDFKSNSAVAWSNKSDFACANAFNNSIIPEDTFFPSPESSSDKTHT<br>CPPCPAPEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKALPAPIEKT<br>ISKAKGQPREPQVYTLPPSREEMTKNQVSLTCLVKGFYPSDIAVEWESNGQPENN<br>YKTTPPVLDSDGSFFLYSKLTVDKSRWQQGNVFSCSVMHEALHNHYTQKSLSLSP<br>GK |
| T3-Design_2-QQQQ (IgG1) | LC | 12 VL(CD3)-LCJ2-CAlpha(T49C)(N34Q + N68Q + N79Q) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPDIQNPDPAVYQLRDSKSSDKSVCLFTDFDSQTQVSQSKDSDVYITDKCVLDM<br>RSMDFKSNSAVAWSQKSDFACANAFQNSIIPEDTFFPSPESS |
| | HC | 13 VH(CD3)-HCJ2-CBeta(S56C)(N69Q)-CJ' 1G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSEAEISHTQKATLVCLATGFYPDHVELSWWV<br>NGKEVHSGVCTDPQPLKEQPALQDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| T3-Design_2-AAAA (IgG1) | LC | 14 VL(CD3)-LCJ2-CAlpha(T49C)(N34A + N68A + N79A) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPDIQNPDPAVYQLRDSKSSDKSVCLFTDFDSQTAVSQSKDSDVYITDKCVLDM<br>RSMDFKSNSAVAWSAKSDFACANAFANSIIPEDTFFPSPESS |
| | HC | 15 VH(CD3)-HCJ2-CBeta(S56C)(N69A)-CJ' 1G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSEAEISHTQKATLVCLATGFYPDHVELSWWV<br>NGKEVHSGVCTDPQPLKEQPALADSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| T3-Design_2-QSKE (IgG1) | LC | 16 VL(CD3)-LCJ2-CAlpha(T49C)(N34Q + N68S + N79K) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPDIQNPDPAVYQLRDSKSSDKSVCLFTDFDSQTQVSQSKDSDVYITDKCVLDM<br>RSMDFKSNSAVAWSSKSDFACANAFKNSIIPEDTFFPSPESS |
| | HC | 17 VH(CD3)-HCJ2-CBeta(S56C)(N69E)-CJ' 1G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSEAEISHTQKATLVCLATGFYPDHVELSWWV<br>NGKEVHSGVCTDPQPLKEQPALEDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |

TABLE 20-continued

Sequences for exemplary polypeptide complexes

| | | | | |
|---|---|---|---|---|
| T3-Design_2-ASKE (IgG1) | LC | 18 | VL(CD3)-LCJ2-CAlpha(T49C)(N34A + N68S + N79K) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IKPDIQNPDPAVYQLRDSKSSDKSVCLFTDFDSQTAVSQSKDSDVYITDKCVLDM RSMDFKSNSAVAWSSKSDFACANAFKNSIIPEDTFFPSPESS |
| | HC | 17 | VH(CD3)-HCJ2-CBeta(S56C)(N69E)-CJ' 1G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVLEDLKNVFPPEVAVFEPSEAEISHTQKATLVCLATGFYPDHVELSWWV NGKEVHSGVCTDPQPLKEQPALEDSRYALSSRLRVSATFWQNPRNHFRCQVQFYG LSENDEWTQDRAKPVTQIVSAEAWGRASDKTHTCPPCPAPEAAGGPSVFLFPPKP KDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREE MTKNQVSLTCLVKGFYPSDIAVEWESNGQPENNYKTTPPVLDSDGSFFLYSKLTV DKSRWQQGNVFSCSVMHEALHNHYTQKSLSLSPGK |
| T3-Design_2-QQQQQ (IgG1) | LC | 19 | VL(CD3)-LCJ2-CAlpha(T49C)(N34Q + N68Q + N79Q + N61Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IKPDIQNPDPAVYQLRDSKSSDKSVCLFTDFDSQTQVSQSKDSDVYITDKCVLDM RSMDFKSNSAVAWSQKSDFACANAFQNSIIPEDTFFPSPESS |
| | HC | 20 | VH(CD3)-HCJ2-CBeta(S56C)(N69Q)-CJ' 1G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVLEDLKNVFPPEVAVFEPSEAEISHTQKATLVCLATGFYPDHVELSWWV NGKEVHSGVCTDPQPLKEQPALQDSRYALSSRLRVSATFWQNPRNHFRCQVQFYG LSENDEWTQDRAKPVTQIVSAEAWGRASDKTHTCPPCPAPEAAGGPSVFLFPPKP KDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREE MTKNQVSLTCLVKGFYPSDIAVEWESNGQPENNYKTTPPVLDSDGSFFLYSKLTV DKSRWQQGNVFSCSVMHEALHNHYTQKSLSLSPGK |
| T3-Design_2-QQQQ (IgG4) | LC | 12 | | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IKPDIQNPDPAVYQLRDSKSSDKSVCLFTDFDSQTQVSQSKDSDVYITDKCVLDM RSMDFKSNSAVAWSQKSDFACANAFQNSIIPEDTFFPSPESS |
| | HC | 21 | VH(CD3)-HCJ2-CBeta(S56C)(N69Q)-CJ' 1G4-Fc(G4) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVLEDLKNVFPPEVAVFEPSEAEISHTQKATLVCLATGFYPDHVELSWWV NGKEVHSGVCTDPQPLKEQPALQDSRYALSSRLRVSATFWQNPRNHFRCQVQFYG LSENDEWTQDRAKPVTQIVSAEAWGRYGPPCPPCPAPEFLGGPSVFLFPPKPKDT LMISRTPEVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQEEMTK NQVSLTCLVKGFYPSDIAVEWESNGQPENNYKTTPPVLDSDGSFFLYSRLTVDKS RWQEGNVFSCSVMHEALHNHYTQKSLSLSLGK |
| E17-Design_2-QQQQ (IgG1) | T3-LC | 12 | VL(CD3)-LCJ2-CAlpha(T49C)(N34Q + N68Q + N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IKPDIQNPDPAVYQLRDSKSSDKSVCLFTDFDSQTQVSQSKDSDVYITDKCVLDM RSMDFKSNSAVAWSQKSDFACANAFQNSIIPEDTFFPSPESS |
| | T3-HC | 22 | VH(CD3)-HCJ2-CBeta(S56C)(N69Q)-CJ' 1G1-Fc(G1)(Knob) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVLEDLKNVFPPEVAVFEPSEAEISHTQKATLVCLATGFYPDHVELSWWV NGKEVHSGVCTDPQPLKEQPALQDSRYALSSRLRVSATFWQNPRNHFRCQVQFYG LSENDEWTQDRAKPVTQIVSAEAWGRASDKTHTCPPCPAPEAAGGPSVFLFPPKP KDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPCREE MTKNQVSLWCLVKGFYPSDIAVEWESNGQPENNYKTTPPVLDSDGSFFLYSKLTV DKSRWQQGNVFSCSVMHEALHNHYTQKSLSLSPGK |
| | U4-LC | 23 | VL(CD19)-CL | DIQLTQSPSFLSASVGDRVTITCSASSTVNYMHWYQQKPGKAPKLLIYSTSNLAS GVPSRFSGSGSGTEFTLTISSLQPEDFATYYCHQWSSYPYTFGQGTKLEIKRTVA APSVFIFPPSDEQLKSGTASVVCLLNNFYPREAKVQWKVDNALQSGNSQESVTEQ DSKDSTYSLSSTLTLSKADYEKHKVYACEVTHQGLSSPVTKSFNRGEC |
| | U4-HC | 24 | VH(CD19)-CH1-Fc(G1)(Hole) | QMQLVQSGPEVKKPGTSVKVSCKASGYAFTSYNMYWVRQARGQRLEWIGYIDPYN GDTTYNQKFKGRVTITRDMSTSTAYMELSSLRSEDTAVYYCLTTAYAMDYWGQGT LVTVSSASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKRVEPKSCD KTHTCPPCPAPEAAGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAP IEKTISKAKGQPREPQVCTLPPSREEMTKNQVSLSCAVKGFYPSDIAVEWESNGQ PENNYKTTPPVLDSDGSFFLVSKLTVDKSRWQQGNVFSCSVMHEALHNHYTQKSL SLSPGK |

TABLE 20-continued

Sequences for exemplary polypeptide complexes

| | | | |
|---|---|---|---|
| E17-Design_2-QQQQ (IgG4) | T3-LC | 12VL(CD3)-LCJ2-CAlpha(T49C) (N34Q + N68Q + N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IKPDIQNPDPAVYQLRDSKSSDKSVCLFTDFDSQTQVSQSKDSDVYITDKCVLDM RSMDFKSNSAVAWSQKSDFACANAFQNSIIPEDTFFPSPESS |
| | T3-HC | 25VH(CD3)-HCJ2-CBeta(S56C) (N69Q)-CJ' 1G4-Fc(G4) (Knob) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVLEDLKNVFPPEVAVFEPSEAEISHTQKATLVCLATGFYPDHVELSWWV NGKEVHSGVCTDPQPLKEQPALQDSRYALSSRLRVSATFWQNPRNHFRCQVQFYG LSENDEWTQDRAKPVTQIVSAEAWGRYGPPCPPCPAPEFLGGPSVFLFPPKPKDT LMISRTPEVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPCQEEMTK NQVSLWCLVKGFYPSDIAVEWESNGQPENNYKTTPPVLDSDGSFFLYSRLTVDKS RWQEGNVFSCSVMHEALHNHYTQKSLSLSLGK |
| | U4-LC | 23VL(CD19)-CL | DIQLTQSPSFLSASVGDRVTITCSASSTVNYMHWYQQKPGKAPKLLIYSTSNLAS GVPSRFSGSGSGTEFTLTISSLQPEDFATYYCHQWSSYPYTFGQGTKLEIKRTVA APSVFIFPPSDEQLKSGTASVVCLLNNFYPREAKVQWKVDNALQSGNSQESVTEQ DSKDSTYSLSSTLTLSKADYEKHKVYACEVTHQGLSSPVTKSFNRGEC |
| | U4-HC | 26VH(CD19)-CH1-Fc(G4) (Hole) | QMQLVQSGPEVKKPGTSVKVSCKASGYAFTSYNMYWVRQARGQRLEWIGYIDPYN GDTTYNQKFKGRVTITRDMSTSTAYMELSSLRSEDTAVYYCLTTAYAMDYWGQGT LVTVSSASTKGPSVFPLAPCSRSTSESTAALGCLVKDYFPEPVTVSWNSGALTSG VHTFPAVLQSSGLYSLSSVVTVPSSSLGTKTYTCNVDHKPSNTKVDKRVESKYGP PCPPCPAPEFLGGPSVFLFPPKPKDTLMISRTPEVTCVVVDVSQEDPEVQFNWYV DGVEVHNAKTKPREEQFNSTYRVVSVLTVLHQDWLNGKEYKCKVSNKGLPSSIEK TISKAKGQPREPQVCTLPPSQEEMTKNQVSLSCAVKGFYPSDIAVEWESNGQPEN NYKTTPPVLDSDGSFFLVSRLTVDKSRWQEGNVFSCSVMHEALHNHYTQKSLSLS LGK |
| F16-Design_2-QQQQ (IgG4) | T3-LC | 12 | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IKPDIQNPDPAVYQLRDSKSSDKSVCLFTDFDSQTQVSQSKDSDVYITDKCVLDM RSMDFKSNSAVAWSQKSDFACANAFQNSIIPEDTFFPSPESS |
| | T3-HC | 25 | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVLEDLKNVFPPEVAVFEPSEAEISHTQKATLVCLATGFYPDHVELSWWV NGKEVHSGVCTDPQPLKEQPALQDSRYALSSRLRVSATFWQNPRNHFRCQVQFYG LSENDEWTQDRAKPVTQIVSAEAWGRYGPPCPPCPAPEFLGGPSVFLFPPKPKDT LMISRTPEVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPCQEEMTK NQVSLWCLVKGFYPSDIAVEWESNGQPENNYKTTPPVLDSDGSFFLYSRLTVDKS RWQEGNVFSCSVMHEALHNHYTQKSLSLSLGK |
| | U4-LC | 23VL(CD19)-CL | DIQLTQSPSFLSASVGDRVTITCSASSTVNYMHWYQQKPGKAPKLLIYSTSNLAS GVPSRFSGSGSGTEFTLTISSLQPEDFATYYCHQWSSYPYTFGQGTKLEIKRTVA APSVFIFPPSDEQLKSGTASVVCLLNNFYPREAKVQWKVDNALQSGNSQESVTEQ DSKDSTYSLSSTLTLSKADYEKHKVYACEVTHQGLSSPVTKSFNRGEC |
| | U4-HC | 27VH(CD19)-CH1- Spacer-VH(CD19)-CH1- Fc(G4) (Hole) | QMQLVQSGPEVKKPGTSVKVSCKASGYAFTSYNMYWVRQARGQRLEWIGYIDPYN GDTTYNQKFKGRVTITRDMSTSTAYMELSSLRSEDTAVYYCLTTAYAMDYWGQGT LVTVSSASTKGPSVFPLAPCSRSTSESTAALGCLVKDYFPEPVTVSWNSGALTSG VHTFPAVLQSSGLYSLSSVVTVPSSSLGTKTYTCNVDHKPSNTKVDKRVGGGGSG GGGSQMQLVQSGPEVKKPGTSVKVSCKASGYAFTSYNMYWVRQARGQRLEWIGYI DPYNGDTTYNQKFKGRVTITRDMSTSTAYMELSSLRSEDTAVYYCLTTAYAMDYW GQGTLVTVSSASTKGPSVFPLAPCSRSTSESTAALGCLVKDYFPEPVTVSWNSGA LTSGVHTFPAVLQSSGLYSLSSVVTVPSSSLGTKTYTCNVDHKPSNTKVDKRVES KYGPPCPPCPAPEFLGGPSVFLFPPKPKDTLMISRTPEVTCVVVDVSQEDPEVQF NWYVDGVEVHNAKTKPREEQFNSTYRVVSVLTVLHQDWLNGKEYKCKVSNKGLPS SIEKTISKAKGQPREPQVCTLPPSQEEMTKNQVSLSCAVKGFYPSDIAVEWESNG QPENNYKTTPPVLDSDGSFFLVSRLTVDKSRWQEGNVFSCSVMHEALHNHYTQKS LSLSLGK |
| Fc-IgG1 (knob) | | 304 | SVFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQV YTLPPCREEMTKNQVSLWCLVKGFYPSDIAVEWESNGQPENNYKTTPPVLDSDGS FFLYSKLTVDKSRWQQGNVFSCSVMHEALHNHYTQKSLSLSPGK |
| Fc-IgG4 (knob) | | 305 | SVFLFPPKPKDTLMISRTPEVTCVVVDVSQEDPEVQFNWYVDGVEVHNAKTKPRE EQFNSTYRVVSVLTVLHQDWLNGKEYKCKVSNKGLPSSIEKTISKAKGQPREPQV YTLPPCQEEMTKNQVSLWCLVKGFYPSDIAVEWESNGQPENNYKTTPPVLDSDGS FFLYSRLTVDKSRWQEGNVFSCSVMHEALHNHYTQKSLSLSLGK |

TABLE 20-continued

Sequences for exemplary polypeptide complexes

| | | | | |
|---|---|---|---|---|
| T3-Fab-Design_2.his1 | LC | 3 | VL(CD3)-LCJ2-CAlpha(T49C) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPDIQNPDPAVYQLRDSKSSDKSVCLFTDFDSQTNVSQSKDSDVYITDKCVLDM<br>RSMDFKSNSAVAWSNKSDFACANAFNNSIIPEDTFFPSPESS |
| | HC | 28 | VH(CD3)-HCJ2-CBeta(S56C)C onjunction' | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYFDYWG<br>QGTLVTVLEDLKNVFPPEVAVFEPSEAEISHTQKATLVCLATGFYPDHVELSWWV<br>NGKEVHSGVCTDPQPLKEQPALNDSRYALSSRLRVSATFWQNPRNHFRCQVQFYG<br>LSENDEWTQDRAKPVTQIVSAEAWGR |
| T3-Fab-Design_2.his2 | LC | 3 | | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPDIQNPDPAVYQLRDSKSSDKSVCLFTDFDSQTNVSQSKDSDVYITDKCVLDM<br>RSMDFKSNSAVAWSNKSDFACANAFNNSIIPEDTFFPSPESS |
| | HC | 29 | VH(CD3)-HCJ2-CBeta(S56C)C onjunction' | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYFDYWG<br>QGTLVTVLEDLKNVFPPEVAVFEPSEAEISHTQKATLVCLATGFYPDHVELSWWV<br>NGKEVHSGVCTDPQPLKEQPALNDSRYALSSRLRVSATFWQNPRNHFRCQVQFYG<br>LSENDEWTQDRAKPVTQIVSAEAWGRAD |
| T3-Fab-Design_2-QQQQ.his1 | LC | 12 | VL(CD3)-LCJ2-CAlpha(T49C) (N34Q + N68Q + N79Q) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPDIQNPDPAVYQLRDSKSSDKSVCLFTDFDSQTQVSQSKDSDVYITDKCVLDM<br>RSMDFKSNSAVAWSQKSDFACANAFQNSIIPEDTFFPSPESS |
| | HC | 30 | VH(CD3)-HCJ2-CBeta(S56C) (N69Q)-His1 | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYFDYWG<br>QGTLVTVLEDLKNVFPPEVAVFEPSEAEISHTQKATLVCLATGFYPDHVELSWWV<br>NGKEVHSGVCTDPQPLKEQPALQDSRYALSSRLRVSATFWQNPRNHFRCQVQFYG<br>LSENDEWTQDRAKPVTQIVSAEAWGR |
| T3-Fab-Design_2-QQQQ.his2 | LC | 12 | | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPDIQNPDPAVYQLRDSKSSDKSVCLFTDFDSQTQVSQSKDSDVYITDKCVLDM<br>RSMDFKSNSAVAWSQKSDFACANAFQNSIIPEDTFFPSPESS |
| | HC | 31 | VH(CD3)-HCJ2-CBeta(S56C) (N69Q)-His2 | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYFDYWG<br>QGTLVTVLEDLKNVFPPEVAVFEPSEAEISHTQKATLVCLATGFYPDHVELSWWV<br>NGKEVHSGVCTDPQPLKEQPALQDSRYALSSRLRVSATFWQNPRNHFRCQVQFYG<br>LSENDEWTQDRAKPVTQIVSAEAWGRAD |
| CBeta | CBeta_1_noCys | 32 | CBeta (C74A) | EVAVFEPSEAEISHTQKATLVCLATGFYPDHVELSWWVNGKEVHSGVSTDPQPLK<br>EQPALNDSRYALSSRLRVSATFWQNPRNHFRCQVQFYGLSENDEWTQDRAKPVTQ<br>IVSAEA |
| | CBeta_1 | 33 | CBeta(S56C) (C74A) | EVAVFEPSEAEISHTQKATLVCLATGFYPDHVELSWWVNGKEVHSGVCTDPQPLK<br>EQPALNDSRYALSSRLRVSATFWQNPRNHFRCQVQFYGLSENDEWTQDRAKPVTQ<br>IVSAEA |
| | CBeta_1-Q | 34 | CBeta(S56C) (N69Q)(C74A) | EVAVFEPSEAEISHTQKATLVCLATGFYPDHVELSWWVNGKEVHSGVCTDPQPLK<br>EQPALQDSRYALSSRLRVSATFWQNPRNHFRCQVQFYGLSENDEWTQDRAKPVTQ<br>IVSAEA |
| | CBeta_1-A | 35 | CBeta(S56C) (N69A)(C74A) | EVAVFEPSEAEISHTQKATLVCLATGFYPDHVELSWWVNGKEVHSGVCTDPQPLK<br>EQPALADSRYALSSRLRVSATFWQNPRNHFRCQVQFYGLSENDEWTQDRAKPVTQ<br>IVSAEA |
| | CBeta_1-E | 36 | CBeta(S56C) (N69E)(C74A) | EVAVFEPSEAEISHTQKATLVCLATGFYPDHVELSWWVNGKEVHSGVCTDPQPLK<br>EQPALEDSRYALSSRLRVSATFWQNPRNHFRCQVQFYGLSENDEWTQDRAKPVTQ<br>IVSAEA |
| | CBeta_2 | 37 | CBeta(S56C)(FG-)(C74A) | EVAVFEPSEAEISHTQKATLVCLATGFYPDHVELSWWVNGKEVHSGVCTDPQPLK<br>EQPALNDSRYALSSRLRVSATFWQNPRNHFRCQVQFYPSN-------------<br>QIVSAEA |
| | CBeta_2-Q | 38 | CBeta(S56C) (N69Q)(FG-) (C74A) | EVAVFEPSEAEISHTQKATLVCLATGFYPDHVELSWWVNGKEVHSGVCTDPQPLK<br>EQPALQDSRYALSSRLRVSATFWQNPRNHFRCQVQFYPSN-------------<br>QIVSAEA |
| | CBeta_2-A | 39 | CBeta(S56C) (N69A)(FG-) (C74A) | EVAVFEPSEAEISHTQKATLVCLATGFYPDHVELSWWVNGKEVHSGVCTDPQPLK<br>EQPALADSRYALSSRLRVSATFWQNPRNHFRCQVQFYPSN-------------<br>QIVSAEA |
| | CBeta_2-E | 40 | CBeta(S56C) (N69E)(FG-) (C74A) | EVAVFEPSEAEISHTQKATLVCLATGFYPDHVELSWWVNGKEVHSGVCTDPQPLK<br>EQPALEDSRYALSSRLRVSATFWQNPRNHFRCQVQFYPSN-------------<br>QIVSAEA |
| | CBeta_3 | 41 | CBeta(S56C)(FG-DE-) (C74A) | EVAVFEPSEAEISHTQKATLVCLATGFYPDHVELSWWVNGKEVHSGVCTDPQPLK<br>EQ---S-GRYALSSRLRVSATFWQNPRNHFRCQVQFYPSN-------------<br>QIVSAEA |

TABLE 20-continued

Sequences for exemplary polypeptide complexes

| | | | | |
|---|---|---|---|---|
| CAlpha | CAlpha_1 noCys | 42 CAlpha | AVYQLRDSKSSDKSVCLFTDFDSQTNVSQSKDSDVYITDKTVLDMRSMDFKSNSA VAWSNKSDFACANAFNNSIIPEDTFFPSPESS | |
| | CAlpha_1 | 43 CAlpha(T49C) | AVYQLRDSKSSDKSVCLFTDFDSQTNVSQSKDSDVYITDKCVLDMRSMDFKSNSA VAWSNKSDFACANAFNNSIIPEDTFFPSPESS | |
| | CAlpha_1-QQQ | 44 CAlpha(T49C) (N34Q + N68Q + N79Q) | AVYQLRDSKSSDKSVCLFTDFDSQTQVSQSKDSDVYITDKCVLDMRSMDFKSNSA VAWSQKSDFACANAFQNSIIPEDTFFPSPESS | |
| | CAlpha_1-AAA | 45 CAlpha(T49C) (N34A + N68A + N79A) | AVYQLRDSKSSDKSVCLFTDFDSQTAVSQSKDSDVYITDKCVLDMRSMDFKSNSA VAWSAKSDFACANAFANSIIPEDTFFPSPESS | |
| | CAlpha_1-QSK | 46 CAlpha(T49C) (N34Q + N68S + N79K) | AVYQLRDSKSSDKSVCLFTDFDSQTQVSQSKDSDVYITDKCVLDMRSMDFKSNSA VAWSSKSDFACANAFKNSIIPEDTFFPSPESS | |
| | CAlpha_1-ASK | 47 CAlpha(T49C) (N34A + N68S + N79K) | AVYQLRDSKSSDKSVCLFTDFDSQTAVSQSKDSDVYITDKCVLDMRSMDFKSNSA VAWSSKSDFACANAFKNSIIPEDTFFPSPESS | |
| | CAlpha_1-QQQQ | 48 CAlpha(T49C) (N34Q + N68Q + N79Q + N61Q) | AVYQLRDSKSSDKSVCLFTDFDSQTQVSQSKDSDVYITDKCVLDMRSMDFKSQSA VAWSQKSDFACANAFQNSIIPEDTFFPSPESS | |
| ConjunctionX | HConjunction_1 | 49 VH-CBetaCJ1 | SSASKNVFPP | |
| | HConjunction_2 | 50 VH-CBetaCJ2 | LEDLKNVFPP | |
| ConjunctionZ | LConjunction_1 | 51 VL-CAlphaCJ1 | KRTVAAPDP | |
| | LConjunction_2 | 52 VL-CAlphaCJ2 | KPDIQNPDP | |
| Conjunction'Y | Conjunction 'IgG1 | 53 CBeta-Conjunction' (IgG1)CJ1 | WGRASDKTHTCPPCPAPEAAGGP | |
| | Conjunction' IgG4 | 54 CBeta-Conjunction' (IgG4)CJ1 | WGR---YGPPCPPCPAPEFLGGP | |
| | | 307 | FE | |
| | | 308 VH-CBetaCJ2 | KLEDLKNVFPP | |
| | | 309 VL-Cpre-AlphaCJB | KPTGVGGTP | |
| | | 306 Cter (crossed light chain cter) | WGRA | |

| PreAlpha-Beta Designs | Chain Name | SEQ ID No | Sequences |
|---|---|---|---|
| Design_1_Pre _TCR_Conjunction'1 | LC | 64 VL(CD3)-LCJB-CPreAlpha(N50 Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IKPTGVGGTPFPSLAPPIMLLVDGKQQMVVVCLVLDVAPPGLDSPIWFSAGQGSA LDAFTYGPSPATDGTWTNLAHLSLPSEELASWEPLVCHTGPGAEGHSRSTQPMHL SGEASTART |
| | HC | 65 VH(CD3)-HCJB-CB eta(N69Q)-CJ' 1G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVLEDLKNVFPPEVAVFEPSEAEISHTQKATLVCLATGFYPDHVELSWWV NGKEVHSGVSTDPQPLKEQPALQDSRYALSSRLRVSATFWQNPRNHFRCQVQFYG LSENDEWTQDRAKPVTQIVSAEAWGRASDKTHTCPPCPAPEAAGGPSVFLFPPKP KDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREE MTKNQVSLTCLVKGFYPSDIAVEWESNGQPENNYKTTPPVLDSDGSFFLYSKLTV DKSRWQQGNVFSCSVMHEALHNHYTQKSLSLSPGK |
| Design_2_Pre _TCR_Conjunction'1_Cys10 | LC | 66 VL(CD3)-LCJB-CPreAlpha (Y59C)(N50Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IKPTGVGGTPFPSLAPPIMLLVDGKQQMVVVCLVLDVAPPGLDSPIWFSAGQGSA LDAFTCGPSPATDGTWTNLAHLSLPSEELASWEPLVCHTGPGAEGHSRSTQPMHL SGEASTART |
| | HC | 67 VH(CD3)-HCJB-CBeta(S76C) (N69Q)-CJ' 1G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVLEDLKNVFPPEVAVFEPSEAEISHTQKATLVCLATGFYPDHVELSWWV NGKEVHSGVSTDPQPLKEQPALQDSRYALCSRLRVSATFWQNPRNHFRCQVQFYG LSENDEWTQDRAKPVTQIVSAEAWGRASDKTHTCPPCPAPEAAGGPSVFLFPPKP KDTLMISRTPEVTCVVVDVSHEDPEVKFNWYVDGVEVHNAKTKPREEQYNSTYRV |

TABLE 20-continued

Sequences for exemplary polypeptide complexes

| | | | |
|---|---|---|---|
| | | | VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| Design_3_Pre<br>_TCR_Conju<br>nction'1_Cys1<br>1 | LC | 68 VL(CD3)-<br>LCJB-<br>CPreAlpha<br>(A13C)(N50Q) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPTGVGGTPFPSLCPPIMLLVDGKQQMVVVCLVLDVAPPGLDSPIWFSAGQGSA<br>LDAFTYGPSPATDGTWTNLAHLSLPSEELASWEPLVCHTGPGAEGHSRSTQPMHL<br>SGEASTART |
| | HC | 69 VH(CD3)-<br>HCJB-<br>CBeta(F13C)<br>(N69Q)-<br>CJ' 1G1-<br>Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVCEPSEAEISHTQKATLVCLATGFYPDHVELSWWV<br>NGKEVHSGVSTDPQPLKEQPALQDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| Design_4_Pre<br>_TCR_Conju<br>nction'1_Cys1<br>2 | LC | 68 VL(CD3)-<br>LCJB-<br>CPreAlpha<br>(A13 C)(N50Q) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPTGVGGTPFPSLCPPIMLLVDGKQQMVVVCLVLDVAPPGLDSPIWFSAGQGSA<br>LDAFTYGPSPATDGTWTNLAHLSLPSEELASWEPLVCHTGPGAEGHSRSTQPMHL<br>SGEASTART |
| | HC | 70 VH(CD3)-<br>HCJB-<br>CBeta(S16C)<br>(N69Q)-<br>CJ' 1G1-<br>Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPCEAEISHTQKATLVCLATGFYPDHVELSWWV<br>NGKEVHSGVSTDPQPLKEQPALQDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| Design_5_Pre<br>_TCR_Conju<br>nction'1_Cys1<br>3 | LC | 71 VL(CD3)-<br>LCJB-<br>CPreAlpha<br>(S11C)(N50Q) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPTGVGGTPFPCLAPPIMLLVDGKQQMVVVCLVLDVAPPGLDSPIWFSAGQGSA<br>LDAFTYGPSPATDGTWTNLAHLSLPSEELASWEPLVCHTGPGAEGHSRSTQPMHL<br>SGEASTART |
| | HC | 70 VH(CD3)-<br>HCJB-<br>CBeta(S16C)<br>(N69Q)-<br>CJ' 1G1-<br>Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPCEAEISHTQKATLVCLATGFYPDHVELSWWV<br>NGKEVHSGVSTDPQPLKEQPALQDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| Design_6_Pre<br>_TCR_Conju<br>nction'1_Cys1<br>4 | LC | 71 VL(CD3)-<br>LCJB-<br>CPreAlpha<br>(S11C)(N50Q) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPTGVGGTPFPCLAPPIMLLVDGKQQMVVVCLVLDVAPPGLDSPIWFSAGQGSA<br>LDAFTYGPSPATDGTWTNLAHLSLPSEELASWEPLVCHTGPGAEGHSRSTQPMHL<br>SGEASTART |
| | HC | 72 VH(CD3)-<br>HCJB-<br>CBeta(A18C)<br>(N69Q)-<br>CJ' 1G1-<br>Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSECEISHTQKATLVCLATGFYPDHVELSWWV<br>NGKEVHSGVSTDPQPLKEQPALQDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| Design_7_Pre<br>_TCR_Conju<br>nction'1_Cys1<br>5 | LC | 71 VL(CD3)-<br>LCJB-<br>CPreAlpha<br>(S11C)(N50Q) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPTGVGGTPFPCLAPPIMLLVDGKQQMVVVCLVLDVAPPGLDSPIWFSAGQGSA<br>LDAFTYGPSPATDGTWTNLAHLSLPSEELASWEPLVCHTGPGAEGHSRSTQPMHL<br>SGEASTART |
| | HC | 73 VH(CD3)-<br>HCJB-<br>CBeta(E19C)<br>(N69Q)-<br>CJ' 1G1-<br>Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSEACISHTQKATLVCLATGFYPDHVELSWWV<br>NGKEVHSGVSTDPQPLKEQPALQDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |

TABLE 20-continued

Sequences for exemplary polypeptide complexes

| | | | | |
|---|---|---|---|---|
| Design_8_Pre_TCR_Conjunction'1_Cys1_4L4T_1 | LC | 74 | VL(CD3)-LCJB-CPreAlpha(S62C)(N50Q) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPTGVGGTPFPSLAPPIMLLVDGKQQMVVVCLVLDVAPPGLDSPIWFSAGQGSA<br>LDAFTYGPCPATDGTWTNLAHLSLPSEELASWEPLVCHTGPGAEGHSRSTQPMHL<br>SGEASTART |
| | HC | 75 | VH(CD3)-HCJB-CBeta(S56C)(N69Q)-CJ' 1G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSEAEISHTQKATLVCLATGFYPDHVELSWWV<br>NGKEVHSGVCTDPQPLKEQPALQDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| Design_9_Pre_TCR_Conjunction'1_Cys2_4L4T_2 | LC | 76 | VL(CD3)-LCJB-CPreAlpha(T65C)(N50Q) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPTGVGGTPFPSLAPPIMLLVDGKQQMVVVCLVLDVAPPGLDSPIWFSAGQGSA<br>LDAFTYGPSPACDGTWTNLAHLSLPSEELASWEPLVCHTGPGAEGHSRSTQPMHL<br>SGEASTART |
| | HC | 75 | VH(CD3)-HCJB-CBeta(S56C)(N69Q)-CJ' 1G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSEAEISHTQKATLVCLATGFYPDHVELSWWV<br>NGKEVHSGVCTDPQPLKEQPALQDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| Design_10_Pre_TCR_Conjunction'1_Cys4 | LC | 77 | VL(CD3)-LCJB-CPreAlpha(I16C)(N50Q) | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPTGVGGTPFPSLAPPCMLLVDGKQQMVVVCLVLDVAPPGLDSPIWFSAGQGSA<br>LDAFTYGPSPATDGTWTNLAHLSLPSEELASWEPLVCHTGPGAEGHSRSTQPMHL<br>SGEASTART |
| | HC | 78 | VH(CD3)-HCJB-CBeta(A11C)(N69Q)-CJ' 1G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVCVFEPSEAEISHTQKATLVCLATGFYPDHVELSWWV<br>NGKEVHSGVSTDPQPLKEQPALQDSRYALSSRLRVSATFWQNPRNHFRCQVQFYG<br>LSENDEWTQDRAKPVTQIVSAEAWGRASDKTHTCPPCPAPEAAGGPSVFLFPPKP<br>KDTLMISRTPEVTCVVVDVSHEDPEVKFNWYVDGVEVHNAKTKPREEQYNSTYRV<br>VSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTV<br>DKSRWQQGNVFSCSVMHEALHNHYTQKSLSLSPGK |
| Design_11_Pre_TCR_Conjunction'2_CTerminal | LC | 58 | | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPTGVGGTPFPSLAPPIMLLVDGKQQMVVVCLVLDVAPPGLDSPIWFSAGQGSA<br>LDAFTYGPSPATDGTWTNLAHLSLPSEELASWEPLVCHTGPGAEGHSRSTQPMHL<br>SGEASTARTCPQEPLRGTPGG |
| | HC | 79 | | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSEAEISHTQKATLVCLATGFYPDHVELSWWV<br>NGKEVHSGVSTDPQPLKEQPALQDSRYALSSRLRVSATFWQNPRNHFRCQVQFYG<br>LSENDEWTQDRAKPVTQIVSAEAWGRADCKTHTCPPCPAPEAAGGPSVFLFPPK<br>PKDTLMISRTPEVTCVVVDVSHEDPEVKFNWYVDGVEVHNAKTKPREEQYNSTYR<br>VVSVLTVLHQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGSFFLYSKLT<br>VDKSRWQQGNVFSCSVMHEALHNHYTQKSLSLSPGK |
| Design_12_Pre_TCR_Conjunction'3C | LC | 63 | | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPTGVGGTPFPSLAPPIMLLVDGKQQMVVVCLVLDVAPPGLDSPIWFSAGQGSA<br>LDAFTYGPSPATDGTWTNLAHLSLPSEELASWEPLVCHTGPGAEGHSRSTQPMHL<br>SGEASTARTC |
| | HC | 80 | | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVLEDLKNVFPPEVAVFEPSEAEISHTQKATLVCLATGFYPDHVELSWWV<br>NGKEVHSGVSTDPQPLKEQPALQDSRYALSSRLRVSATFWQNPRNHFRCQVQFYG<br>LSENDEWTQDRAKPVTQIVSAEAWGRADCGFTSVCPPCPAPEAAGGPSVFLFPPK<br>PKDTLMISRTPEVTCVVVDVSHEDPEVKFNWYVDGVEVHNAKTKPREEQYNSTYR<br>VVSVLTVLHQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGSFFLYSKLT<br>VDKSRWQQGNVFSCSVMHEALHNHYTQKSLSLSPGK |

TABLE 20-continued

Sequences for exemplary polypeptide complexes

| | | | |
|---|---|---|---|
| Conjunction W | LConjunction_3 | 81VL-Cpre-AlphaCJB | PTGVGGTP |
| CPreAlpha | CPreAlpha | 82 | FPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTART |
| | CPreAlpha-noGlyco (Design1) | 83 (N50Q) | FPSLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART |
| | CPreAlpha-noGlyco-Cys (Design2) | 311 (N50Q, Y59C) | FPSLAPPIMLLVDGKQQMVVVCLVLDVAPPGLDSPIWFSAGQGSALDAFTCGPSPATDGTWTNLAHLSLPSEELASWEPLVCHTGPGAEGHSRSTQPMHLSGEASTART |
| | CPreAlpha-noGlyco-Cys (Design3) | 312 (N50Q, A13C) | FPSLCPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART |
| | CPreAlpha-noGlyco-Cys (Design4) | 312 (N50Q, A13C) | |
| | CPreAlpha-noGlyco-Cys (Design5) | 313 (N50Q, S11C) | FPCLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART |
| | CPreAlpha-noGlyco-Cys (Design6) | 313 (N50Q, S11C) | |
| | CPreAlpha-noGlyco-Cys (Design7) | 313 (N50Q, S11C) | |
| | CPreAlpha-noGlyco-Cys (Design8) | 314 (N50Q, S62C) | FPSLAPPIMLLVDGKQQMVVVCLVLDVAPPGLDSPIWFSAGQGSALDAFTYGPCPATDGTWTNLAHLSLPSEELASWEPLVCHTGPGAEGHSRSTQPMHLSGEASTART |
| | CPreAlpha-noGlyco-Cys (Design9) | 315 (N50Q, T65C) | FPSLAPPIMLLVDGKQQMVVVCLVLDVAPPGLDSPIWFSAGQGSALDAFTYGPSPACDGTWTNLAHLSLPSEELASWEPLVCHTGPGAEGHSRSTQPMHLSGEASTART |
| | CPreAlpha-noGlyco-Cys (Design10) | 316 (N50Q, I16C) | FPSLAPPCMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART |
| | CPreAlpha-noGlyco (Design11) | 317 (N50Q, ter_residues) | FPSLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART<u>CPQEPLRGTPGG</u> |
| | CPreAlpha-noGlyco (Design12) | 318 (N50Q, Cter_only) | FPSLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART<u>C</u> |
| Cbeta for_CpreAlpha | CBeta for PreAlpha | 84N69Q | EVAVFEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA |
| | Design_1 | 84N69Q | |
| | Design_2 | 319N69Q, S76C | EVAVFEPSEAEISHTQKATLVCLATGFYPDHVELSWWVNGKEVHSGVSTDPQPLKEQPALQDSRYALCSRLRVSATFWQNPRNHFRCQVQFYGLSENDEWTQDRAKPVTQIVSAEA |
| | Design_3 | 320N69Q, F13C | EVAVCEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA |
| | Design_4 | 321N69Q, S16C | EVAVFEPCEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA |
| | Design_5 | 321N69Q, S16C | |
| | Design_6 | 322N69Q, A18C | EVAVFEPSECEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA |
| | Design_7 | 323N69Q, E19C | EVAVFEPSEACISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA |
| | Design_8 | 34N69Q, S56C | |
| | Design_9 | 34N69Q, S56C | |
| | Design_10 | 324 N69Q, A11C | EVCVFEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA |
| | Design_11 | 84N69Q | |
| | Design_12 | 84N69Q | |

TABLE 20-continued

Sequences for exemplary polypeptide complexes

| Delta-Gamma Designs | Chain Name | SEQ ID NO | | Sequences |
|---|---|---|---|---|
| dg_Design_2_no_Glyco | LC | 85 | VL(CD3)-LCJ5-CDelta (N16Q + N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IEPRSQPHTKPSVFVMKQGTNVACLVKEFYPKDIRINLVSSKKITEFDPAIVISP SGKYNAVKLGKYEDSNSVTCSVQHDQKTVHSTDFE |
| | HC | 86 | VH(CD3)-HCJ5-CGamma-CJ'3G1-Fc(G1)(N65Q) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVTDKQLDADVSPKPTIFLPSIAETKLQKAGTYLCLLEKFPPDVIKIHWQ EKKSNTILGSQEGNTMKTQDTYMKFSWLTVPEESLDKEHRCIVRHENNKNGVDQE IIFPPIKSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPGK |
| dg_Design_2_hypeCys1_no_Glyco | LC | 89 | VL(CD3)-LCJ5-CDelta (N16C) (N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IEPRSQPHTKPSVFVMKCGTNVACLVKEFYPKDIRINLVSSKKITEFDPAIVISP SGKYNAVKLGKYEDSNSVTCSVQHDQKTVHSTDFE |
| | HC | 90 | VH(CD3)-HCJ5-CGamma (T12C) (N65Q)-CJ'3G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVTDKQLDADVSPKPCIFLPSIAETKLQKAGTYLCLLEKFPPDVIKIHWQ EKKSNTILGSQEGNTMKTQDTYMKFSWLTVPEESLDKEHRCIVRHENNKNGVDQE IIFPPIKSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPGK |
| dg_Design_2_hypeCys2_no_Glyco | LC | 91 | VL(CD3)-LCJ5-CDelta (V50C) (N16Q + N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IEPRSQPHTKPSVFVMKQGINVACLVKEFYPKDIRINLVSSKKITEFDPAICISP SGKYNAVKLGKYEDSNSVTCSVQHDQKTVHSTDFE |
| | HC | 92 | VH(CD3)-HCJ5-CGamma (Q57C) (N65Q)-CJ'3G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVTDKQLDADVSPKPTIFLPSIAETKLQKAGTYLCLLEKFPPDVIKIHWQ EKKSNTILGSCEGNTMKTQDTYMKFSWLTVPEESLDKEHRCIVRHENNKNGVDQE IIFPPIKSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPGK |
| dg_Design_2_hypeCys3_no_Glyco | LC | 93 | VL(CD3)-LCJ5-CDelta (D46C) (N16Q + N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IEPRSQPHTKPSVFVMKQGINVACLVKEFYPKDIRINLVSSKKITEFCPAIVISP SGKYNAVKLGKYEDSNSVTCSVQHDQKTVHSTDFE |
| | HC | 94 | VH(CD3)-HCJ5-CGamma (M62C) (N65Q)-CJ'3G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVTDKQLDADVSPKPTIFLPSIAETKLQKAGTYLCLLEKFPPDVIKIHWQ EKKSNTILGSQEGNTCKTQDTYMKFSWLTVPEESLDKEHRCIVRHENNKNGVDQE IIFPPIKSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPGK |
| dg_Design_2_Cys2_no_Glyco | LC | 95 | VL(CD3)-LCJ5-CDelta (P12C) (N16Q + N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IEPRSQPHTKPSVCVMKQGINVACLVKEFYPKDIRINLVSSKKITEFDPAIVISP SGKYNAVKLGKYEDSNSVTCSVQHDQKTVHSTDFE |
| | HC | 96 | VH(CD3)-HCJ5-CGamma (S17C) (N65Q)-CJ'3G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVTDKQLDADVSPKPTIFLPCIAETKLQKAGTYLCLLEKFPPDVIKIHWQ EKKSNTILGSQEGNTMKTQDTYMKFSWLTVPEESLDKEHRCIVRHENNKNGVDQE IIFPPIKSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPGK |

TABLE 20-continued

Sequences for exemplary polypeptide complexes

| | | | |
|---|---|---|---|
| dg_Design_2_Cys1_no_Glyco | LC | 97VL(CD3)-LCJ5-CDelta (M14C) (N16Q + N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IEPRSQPHTKPSVFVCKQGTNVACLVKEFYPKDIRINLVSSKKITEFDPAIVISP SGKYNAVKLGKYEDSNSVTCSVQHDQKTVHSTDFE |
| | HC | 98VH(CD3)-HCJ5-CGamma (F14C) (N65Q)-CJ'3G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVTDKQLDADVSPKPTICLPSIAETKLQKAGTYLCLLEKFFPDVIKIHWQ EKKSNTILGSQEGNTMKTQDTYMKFSWLTVPEESLDKEHRCIVRHENNKNGVDQE IIFPPIKSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPGK |
| dg_Design_2_Cys3_no_Glyco | LC | 95VL(CD3)-LCJ5-CDelta (F12C) (N16Q + N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IEPRSQPHTKPSVCVMKQGINVACLVKEFYPKDIRINLVSSKKITEFDPAIVISP SGKYNAVKLGKYEDSNSVTCSVQHDQKTVHSTDFE |
| | HC | 99VH(CD3)-HCJ5-CGamma (E20C) (N65Q)-CJ'3G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVTDKQLDADVSPKPTIFLPSIACTKLQKAGTYLCLLEKFFPDVIKIHWQ EKKSNTILGSQEGNTMKTQDTYMKFSWLTVPEESLDKEHRCIVRHENNKNGVDQE IIFPPIKSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPGK |
| dg_Design_2_Cys4_no_Glyco | LC | 100VL(CD3)-LCJ5-CDelta (F87C) (N16Q + N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IEPRSQPHTKPSVFVMKQGINVACLVKEFYPKDIRINLVSSKKITEFDPAIVISP SGKYNAVKLGKYEDSNSVTCSVQHDQKTVHSTDCE |
| | HC | 101VH(CD3)-HCJ5-CGamma (A19C) (N65Q)-CJ'3G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVTDKQLDADVSPKPTIFLPSICETKLQKAGTYLCLLEKFFPDVIKIHWQ EKKSNTILGSQEGNTMKTQDTYMKFSWLTVPEESLDKEHRCIVRHENNKNGVDQE IIFPPIKSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPGK |
| dg_Design_2_Cys5_no_Glyco | LC | 102VL(CD3)-LCJ5-CDelta (E88C) (N16Q + N79Q) | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IEPRSQPHTKPSVFVMKQGTNVACLVKEFYPKDIRINLVSSKKITEFDPAIVISP SGKYNAVKLGKYEDSNSVTCSVQHDQKTVHSTDFC |
| | HC | 101VH(CD3)-HCJ5-CGamma (A19C) (N65Q)-CJ'3G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVTDKQLDADVSPKPTIFLPSICETKLQKAGTYLCLLEKFFPDVIKIHWQ EKKSNTILGSQEGNTMKTQDTYMKFSWLTVPEESLDKEHRCIVRHENNKNGVDQE IIFPPIKSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPGK |
| dg_Design_2 | LC | 105VL(CD3)-LCJ5-CDelta | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE IEPRSQPHTKPSVFVMKNGTNVACLVKEFYPKDIRINLVSSKKITEFDPAIVISP SGKYNAVKLGKYEDSNSVTCSVQHDNKTVHSTDFE |
| | HC | 106VH(CD3)-HCJ5-CGamma-CJ'3G1-Fc(G1) | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTVTDKQLDADVSPKPTIFLPSIAETKLQKAGTYLCLLEKFFPDVIKIHWQ EKKSNTILGSQEGNTMKTNDTYMKFSWLTVPEESLDKEHRCIVRHENNKNGVDQE IIFPPIKSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPGK |

TABLE 20-continued

Sequences for exemplary polypeptide complexes

| | | | |
|---|---|---|---|
| dg_Design_1 | LC | 107 VL(CD3)-LCJ4-CDelta | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKPRSQPHTKPSVFVMKNGTNVACLVKEFYPKDIRINLVSSKKITEFDPAIVISP<br>SGKYNAVKLGKYEDSNSVTCSVQHDNKTVHSTDFE |
| | HC | 108 VH(CD3)-HCJ4-CGamma-CJ'3G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVSSASLDADVSPKPTIFLPSIAETKLQKAGTYLCLLEKFFPDVIKIHWQ<br>EKKSNTILGSQEGNTMKTNDTYMKFSWLTVPEESLDKEHRCIVRHENNKNGVDQE<br>IIFPPIKSDKTHTCPPCPAPEAAGGPSVFLFPPKPKDTLMISRTPEVTCVVVDVS<br>HEDPEVKFNWYVDGVEVHNAKTKPREEQYNSTYRVVSVLTVLHQDWLNGKEYKCK<br>VSNKALPAPIEKTISKAKGQPREPQVYTLPPSREEMTKNQVSLTCLVKGFYPSDI<br>AVEWESNGQPENNYKTTPPVLDSDGSFFLYSKLTVDKSRWQQGNVFSCSVMHEAL<br>HNHYTQKSLSLSPGK |
| dg_crossed_Design_1 | LC | 109 VL(CD3)-LCJ6-CGamma | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKDKQLDADVSPKPTIFLPSIAETKLQKAGTYLCLLEKFFPDVIKIHWQEKKSNT<br>ILGSCEGNTMKTQDTYMKFSWLTVPEESLDKEHRCIVRHENNKNGVDQEIIFPPI<br>KTDVITMD |
| | HC | 110 VH(CD3)-HCJ6-CDelta-CJ'4G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVSSRSQPHTKP<u>SVFVMKQ</u>GTNVACLVKEFYPKDIRINLVSSKKITEFDP<br>AI<u>CI</u>SPSGKYNAVKLGKYEDSNSVTCSVQHD<u>Q</u>KTVHSTDEPKSCDKTHTCPPCPA<br>PEAAGGPSVFLFPPKPKDTLMISRTPEVTCVVVDVSHEDPEVKFNWYVDGVEVHN<br>AKTKPREEQYNSTYRVVSVLTVLHQDWLNGKEYKCKVSNKALPAPIEKTISKAKG<br>QPREPQVYTLPPSREEMTKNQVSLTCLVKGFYPSDIAVEWESNGQPENNYKTTPP<br>VLDSDGSFFLYSKLTVDKSRWQQGNVFSCSVMHEALHNHYTQKSLSLSPGK |
| dg_crossed_Design_2 | LC | 111 VL(CD3)-LCJ7-CGamma | DIVMTQSPDSLAVSLGERATINCKSSQSLLNSRTRKNYLAWYQQKPGQPPKLLIY<br>WASTRQSGVPDRFSGSGSGTDFTLTISSLQAEDVAVYYCTQSHTLRTFGGGTKVE<br>IKDKQLDADVSPKPTIFLPSIAETKLQKAGTYLCLLEKFFPDVIKIHWQEKKSNT<br>ILGSCEGNTMKTQDTYMKFSWLTVPEESLDKEHRCIVRHENNKNGVDQEIIFPPI<br>KTDVITMD |
| | HC | 112 VH(CD3)-HCJ7-CDelta-CJ'4G1-Fc(G1) | QVQLVQSGAEVKKPGSSVKVSCKASGFAFTDYYIHWVRQAPGQGLEWMGWISPGN<br>VNTKYNENFKGRVTITADKSTSTAYMELSSLRSEDTAVYYCARDGYSLYYFDYWG<br>QGTLVTVEPRSQPHTKP<u>SVFVMKQ</u>GTNVACLVKEFYPKDIRINLVSSKKITEFDP<br>AI<u>CI</u>SPSGKYNAVKLGKYEDSNSVTCSVQHD<u>Q</u>KTVHSTDEPKSCDKTHTCPPCPA<br>PEAAGGPSVFLFPPKPKDTLMISRTPEVTCVVVDVSHEDPEVKFNWYVDGVEVHN<br>AKTKPREEQYNSTYRVVSVLTVLHQDWLNGKEYKCKVSNKALPAPIEKTISKAKG<br>QPREPQVYTLPPSREEMTKNQVSLTCLVKGFYPSDIAVEWESNGQPENNYKTTPP<br>VLDSDGSFFLYSKLTVDKSRWQQGNVFSCSVMHEALHNHYTQKSLSLSPGK |
| CGamma | CGamma_1 | 113 CGamma | KPTIFLPSIAETKLQKAGTYLCLLEKFFPDVIKIHWQEKKSNTILGSQEGNTMKT<br>NDTYMKFSWLTVPEESLDKEHRCIVRHENNKNGVDQEIIF |
| | CGamma_1<br>no Glyco | 114 CGamma<br>(N65Q) | KPTIFLPSIAETKLQKAGTYLCLLEKFFPDVIKIHWQEKKSNTILGSQEGNTMKT<br>QDTYMKFSWLTVPEESLDKEHRCIVRHENNKNGVDQEIIF |
| | dg_Design_1 | 113 No mutations | |
| | dg_Design_2 | 113 No mutations | |
| | dg_Design_2_no_Glyco | 114 N65Q | |
| | dg_Design_2_hypeCys1_no_Glyco | 333 N65Q, T12C | KP<u>C</u>IFLPSIAETKLQKAGTYLCLLEKFFPDVIKIHWQEKKSNTILGSQEGNTMKT<br><u>Q</u>DTYMKFSWLTVPEESLDKEHRCIVRHENNKNGVDQEIIF |
| | dg_Design_2_hypeCys2_no_Glyco | 334 N65Q, Q57C | KPTIFLPSIAETKLQKAGTYLCLLEKFFPDVIKIHWQEKKSNTILGS<u>C</u>EGNTMKT<br><u>Q</u>DTYMKFSWLTVPEESLDKEHRCIVRHENNKNGVDQEIIF |
| | dg_Design_2_hypeCys3_no_Glyco | 335 N65Q, M62C | KPTIFLPSIAETKLQKAGTYLCLLEKFFPDVIKIHWQEKKSNTILGSQEGNT<u>C</u>KT<br><u>Q</u>DTYMKFSWLTVPEESLDKEHRCIVRHENNKNGVDQEIIF |
| | dg_Design_2_Cys2_no_Glyco | 336 N65Q, S17C | KPTIFLP<u>C</u>IAETKLQKAGTYLCLLEKFFPDVIKIHWQEKKSNTILGSQEGNTMKT<br><u>Q</u>DTYMKFSWLTVPEESLD-KEHRCIVRHENNKNGVDQEIIF |
| | dg_Design_2_Cys1_no_Glyco | 337 N65Q, F14C | KPTI<u>C</u>LPSIAETKLQKAGTYLCLLEKFFPDVIKIHWQEKKSNTILGSQEGNTMKT<br><u>Q</u>DTYMKFSWLTVPEESLDKEHRCIVRHENNKNGVDQEIIF |
| | dg_Design_2_Cys3_no_Glyco | 338 N65Q, E20C | KPTIFLPSIA<u>C</u>TKLQKAGTYLCLLEKFFPDVIKIHWQEKKSNTILGSQEGNTMKT<br><u>Q</u>DTYMKFSWLTVPEESLDKEHRCIVRHENNKNGVDQEIIF |
| | dg_Design_2_Cys4_no_Glyco | 339 N65Q, A19C | KPTIFLPSI<u>C</u>ETKLQKAGTYLCLLEKFFPDVIKIHWQEKKSNTILGSQEGNTMKT<br><u>Q</u>DTYMKFSWLTVPEESLDKEHRCIVRHENNKNGVDQEIIF |
| | dg_Design_2_Cys5_no_Glyco | 339 N65Q, A19C | |

TABLE 20-continued

Sequences for exemplary polypeptide complexes

| | | | |
|---|---|---|---|
| | dg_crossed_Design_1 | 340 | KPTIFLPSIAETKLQKAGTYLCLLEKFFPDVIKIHWQEKKSNTILGSCEGNTMKTQDTYMKFSWLTVPEESLDKEHRCIVRHENNKNGVDQEIIFPPIKTDVITMD |
| | dg_crossed_Design_2 | 340 | |
| CDelta | CDelta_1 | 115 CDelta | SVFVMKNGTNVACLVKEFYPKDIRINLVSSKKITEFDPAIVISPSGKYNAVKLGKYEDSNSVTCSVQHDNKTVHSTDFE |
| | CDelta_1_no_Glyco | 116 CDelta(N16Q + N79Q) | SVFVMKQGTNVACLVKEFYPKDIRINLVSSKKITEFDPAIVISPSGKYNAVKLGKYEDSNSVTCSVQHDQKTVHSTDFE |
| | | 310 CDelta | KSVFVMKNGTNVACLVKEFYPKDIRINLVSSKKITEFDPAIVISPSGKYNAVKLGKYEDSNSVTCSVQHDNKTVHSTDFE |
| | dg_Design_1 | 115 No Mutations | |
| | dg_Design_2 | 115 No Mutations | |
| | dg_Design_2_no_Glyco | 116 N16Q, N79Q | |
| | dg_Design_2_hypeCys1_no_Glyco | 325 N16C, N79Q | SVFVMKCGTNVACLVKEFYPKDIRINLVSSKKITEFDPAIVISPSGKYNAVKLGKYEDSNSVTCSVQHDQKTVHSTDFE |
| | dg_Design_2_hypeCys2_no_Glyco | 326 N16Q, N79Q, V50C | SVFVMKQGTNVACLVKEFYPKDIRINLVSSKKITEFDPAICISPSGKYNAVKLGKYEDSNSVTCSVQHDQKTVHSTDFE |
| | dg_Design_2_hypeCys3_no_Glyco | 327 N16Q, N79Q, D46C | SVFVMKQGTNVACLVKEFYPKDIRINLVSSKKITEFCPAIVISPSGKYNAVKLGKYEDSNSVTCSVQHDQKTVHSTDFE |
| | dg_Design_2_Cys2_no_Glyco | 328 N16Q, N79Q, F12C | SVCVMKQGTNVACLVKEFYPKDIRINLVSSKKITEFDPAIVISPSGKYNAVKLGKYEDSNSVTCSVQHDQKTVHSTDFE |
| | dg_Design_2_Cys1_no_Glyco | 329 N16Q, N79Q, M14C | SVFVCKQGTNVACLVKEFYPKDIRINLVSSKKITEFDPAIVISPSGKYNAVKLGKYEDSNSVTCSVQHDQKTVHSTDFE |
| | dg_Design_2_Cys3_no_Glyco | 328 N16Q, N79Q, F12C | |
| | dg_Design_2_Cys4_no_Glyco | 330 N16Q, N79Q, F87C | SVFVMKQGTNVACLVKEFYPKDIRINLVSSKKITEFDPAIVISPSGKYNAVKLGKYEDSNSVTCSVQHDCE |
| | dg_Design_2_Cys5_no_Glyco | 331 N16Q, N79Q, E88C | SVFVMKQGTNVACLVKEFYPKDIRINLVSSKKITEFDPAIVISPSGKYNAVKLGKYEDSNSVTCSVQHDQKTVHSTDFC |
| | dg_crossed_Design_1 (the delta on heavy chain) | 332 N16Q, N79Q, V50C | SVFVMKQGTNVACLVKEFYPKDIRINLVSSKKITEFDPAICISPSGKYNAVKLGKYEDSNSVTCSVQHDQKTVHSTD-- |
| | dg_crossed_Design_2 (the delta on heavy chain) | 332 | |
| ConjunctionR | H_Conjunction_4 | 117 HCJ4 | SSASLDADVSP |
| | H_Conjunction_5 | 118 HCJ5 | TDKQLDADVSP |
| ConjunctionT | L_Conjunction_4 | 119 LCJ4 | PRSQPHTKP |
| | L_Conjunction_5 | 120 LCJ5 | EPRSQPHTKP |
| Conjunction'S | Conjunction'3_IgG1 | 121 CJ'3G1 | PPIKSDKTHTCPPCPAPEAAGGP |
| | Conjunction'3_IG4 | 122 CJ'3G4 | PPI---YGPPCPPCPAPEFLGGP |
| ConjunctionH | H_Conjunction_6 | 123 HCJ6 | SSRSQPHTKP |
| | H_Conjunction_7 | 124 HCJ7 | EPRSQPHTKP |

TABLE 20-continued

Sequences for exemplary polypeptide complexes

| | | | |
|---|---|---|---|
| ConjunctionJ | L_Conjunction_6 | 125 LCJ6 | KDKLDADVSP |
| | L_Conjunction_7 | 126 LCJ7 | TDKLDADVSP |
| Conjunction'I | Conjunction'4_IgG1 | 127 CJ'4G1 | EPKSSDKTHTCPPCPAPEAAGGP |
| | Conjunction'4_IgG4 | 128 CJ'4G4 | ESK---YGPPCPPCPAPEFLGGP |
| Conjunction (Alpha-Beta, crossed, more antibody) | H_Conjunction_3 | 129 HCJ3 | SSASIQNPDP |
| | L_Conjunction_3 | 50 LCJ3 | |
| Conjunction (Alpha-Beta, crossed, more TCR) | H_Conjunction_4 | 130 HCJ4 | SSPDIQNPDP |
| | L_Conjunction_3 | 50 LCJ3 | |
| Conjunction (PreAlpha-Beta, normal, more antibody) | Light chain Conjunction | 131 LCJA | RTVAAGTP |
| Conjunction (PreAlpha-Beta, crossed, more antibody) | Light chain Conjunction | 50 LCJC | |
| | Heavy chain Conjunction | 132 HCJC | SSASGVGGTP |
| Conjunction (PreAlpha-Beta, crossed, more TCR) | Light chain Conjunction | 50 LCJD | |
| | Heavy chain Conjunction | 133 HCJD | SSPTGVGGTP |
| Conjunction' (Alpha-Beta, PreAlpha-Beta, crossed) | Conjunction' | 134 CJ'2G1 | SDKTHTCPPCPAPEAAGGP |
| | Conjunction' | 135 CJ'2G4 | --YGPPCPPCPAPEFLGGP |
| PreTCR_Design5_crossed_1 | Light | 136 VL(CD3)-HCJB-CBeta (N69Q, S16C)-CJ' 1G | DIVMTQSPDSLAVSLGERATINCKSSQSLLNSRTRKNYLAWYQQKPGQPPKLLIYWASTR QSGVPDRFSGSGSGTDFTLTISSLQAEDVAVYYCTQSHTLRTFGGGTKVEIKLEDLKNVF PPEVAVFEPCEAEISHTQKATLVCLATGFYPDHVELSWWVNGKEVHSGVSTDPQPLKEQP ALQDSRYALSSRLRVSATFWQNPRNHFRCQVQFYGLSENDEWTQDRAKPVTQIVSAEAWG RA |
| | Heavy (Conjunction more antibody) | 137 VH(CD3)-HCJC-CPreAlpha (S11C, N50Q)-CJ'2G1- Fc | QVQLVQSGAEVKKPGSSVKVSCKASGFAFTDYYIHWVRQAPGQGLEWMGWISPGNVNTKY NENFKGRVTITADKSTSTAYMELSSLRSEDTAVYYCARDGYSLYYFDYWGQGTLVTVSSA SGVGGTPFPCLAPPIMLLVDGKQQMVVVCLVLDVAPPGLDSPIWFSAGQGSALDAFTYGP SPATDGTWTNLAHLSLPSEELASWEPLVCHTGPGAEGHSRSTQPMHLSGEASTARTSDKT HTCPPCPAPEAAGGPSVFLFPPKPKDTLMISRTPEVTCVVVDVSHEDPEVKFNWYVDGVE VHNAKTKPREEQYNSTYRVVSVLTVLHQDWLNGKEYKCKVSNKALPAPIEKTISKAKGQP REPQVYTLPPSREEMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| PreTCR_Design_5_crossed_2 | Light | 136 VL(CD3)-HCJB-CBeta (N69Q, S16C)-CJ' 1G | |
| | Heavy (Conjunction more PreTCR) | 138 VH(CD3)-HCJD-CPreAlpha (S11)-CJ'2G1-Fc Conjunction | QVQLVQSGAEVKKPGSSVKVSCKASGFAFTDYYIHWVRQAPGQGLEWMGWISPGNVNTKY NENFKGRVTITADKSTSTAYMELSSLRSEDTAVYYCARDGYSLYYFDYWGQGTLVTVSSP TGVGGTPFPCLAPPIMLLVDGKQQMVVVCLVLDVAPPGLDSPIWFSAGQGSALDAFTYGP SPATDGTWTNLAHLSLPSEELASWEPLVCHTGPGAEGHSRSTQPMHLSGEASTARTSDKT HTCPPCPAPEAAGGPSVFLFPPKPKDTLMISRTPEVTCVVVDVSHEDPEVKFNWYVDGVE VHNAKTKPREEQYNSTYRVVSVLTVLHQDWLNGKEYKCKVSNKALPAPIEKTISKAKGQP REPQVYTLPPSREEMTKNQVSLTCLVKGFYPSDIAVEWESNGQPENNYKTTPPVLDSDGS FFLYSKLTVDKSRWQQGNVFSCSVMHEALHNHYTQKSLSLSPGK |

TABLE 20-continued

Sequences for exemplary polypeptide complexes

| Name | Chain | SEQ ID | Description |
|---|---|---|---|
| PreTCR_Design_6_crossed_1 | Light | 139 | VL(CD3)-LCJC-CBeta (A18C, N69Q) — DIVMTQSPDSLAVSLGERATINCKSSQSLLNSRTRKNYLAWYQQKPGQPPKLLIYWASTR QSGVPDRFSGSGSGTDFTLTISSLQAEDVAVYYCTQSHTLRTFGGGTKVEIKLEDLKNVF PPEVAVFEPSECEISHTQKATLVCLATGFYPDHVELSWWVNGKEVHSGVSTDPQPLKEQP ALQDSRYALSSRLRVSATFWQNPRNHFRCQVQFYGLSENDEWTQDRAKPVTQIVSAEAWG RA |
| | Heavy (Conjunction more antibody) | 137 | |
| PreTCR_Design_6_crossed_2 | Light | 139 | |
| | Heavy (Conjunction more TCR) | 138 | |
| Conjunction' (alpha-beta, crossed, IgG1) | IgG1 | 140 | CJ'2G1 — SDKTHTCPPCPAPEAAGGP |
| Conjunction' (alpha-beta, crossed, IgG4) | IgG4 | 141 | CJ'2G4 — YGPPCPPCPAPEFLGGP |
| Anti-CD3 Antibody VH | | 300 | QVQLVQSGAEVKKPGSSVKVSCKASGFAFTDYYIHWVRQAPGQGLEWMGWISPGN VNTKYNENFKGRVTITADKSTSTAYMELSSLRSEDTAVYYCARDGYSLYYFDYWG QGTLVTV |
| Anti-CD3 Antibody VL | | 301 | DIVMTQSPDSLAVSLGERATINCKSSQSLLNSRTRKNYLAWYQQKPGQPPKLLIY WASTRQSGVPDRFSGSGSGTDFTLTISSLQAEDVAVYYCTQSHTLRTFGGGTKVE I |
| Fc(G1) | | 302 | SVFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| Fc(G4) | | 303 | SVFLFPPKPKDTLMISRTPEVTCVVVDVSQEDPEVQFNWYVDGVEVHNAKTKPRE EQFNSTYRVVSVLTVLHQDWLNGKEYKCKVSNKGLPSSIEKTISKAKGQPREPQV YTLPPSQEEMTKNQVSLTCLVKGFYPSDIAVEWESNGQPENNYKTTPPVLDSDGS FFLYSRLTVDKSRWQEGNVFSCSVMHEALHNHYTQKSLSLSLGK |

EXAMPLES

Example 1: Design and Engineering of Antibody and TCR Chimeric Proteins

TCR Sequences

TCRs are heterodimeric proteins made up of two chains. About 95% human T cells have TCRs consisting of alpha and beta chains, whereas the rest 5% have TCRs composed of gamma and delta chains. The constant region of human alpha chain has only one gene TRAC. The constant region of human beta chain has two subclasses: gene TRBC1 and TRBC2. In Protein Data Bank (PDB), the number of crystal structures of TRBC1 is relatively more than those of TRBC2, so TRBC1 sequences were chosen as the major backbone to design the polypeptide complex disclosed herein ("WuXiBody"). A typical amino acid sequence of TRBC1 can be found in PDB structure 4L4T.

Interchain Disulphide-Bond of TCR

TCR crystal structures were used to guide our WuXiBody design. Unlike native TCR anchored on the membrane of T cell surface, soluble TCR molecules are less stable, although its 3D structure is very similar to antibody Fab. As a matter of fact, the instability of TCR in soluble condition used to be a big obstacle that prevents the elucidation of its crystal structure (Wang 2014, supra). We adopted a strategy of introducing a pair of Cys mutations in the TCR constant region and found it can significantly improve chain assembly and enhance expression.

Effects of Interchain Disulphide Bond on the Antibody Expression

Figure 16:
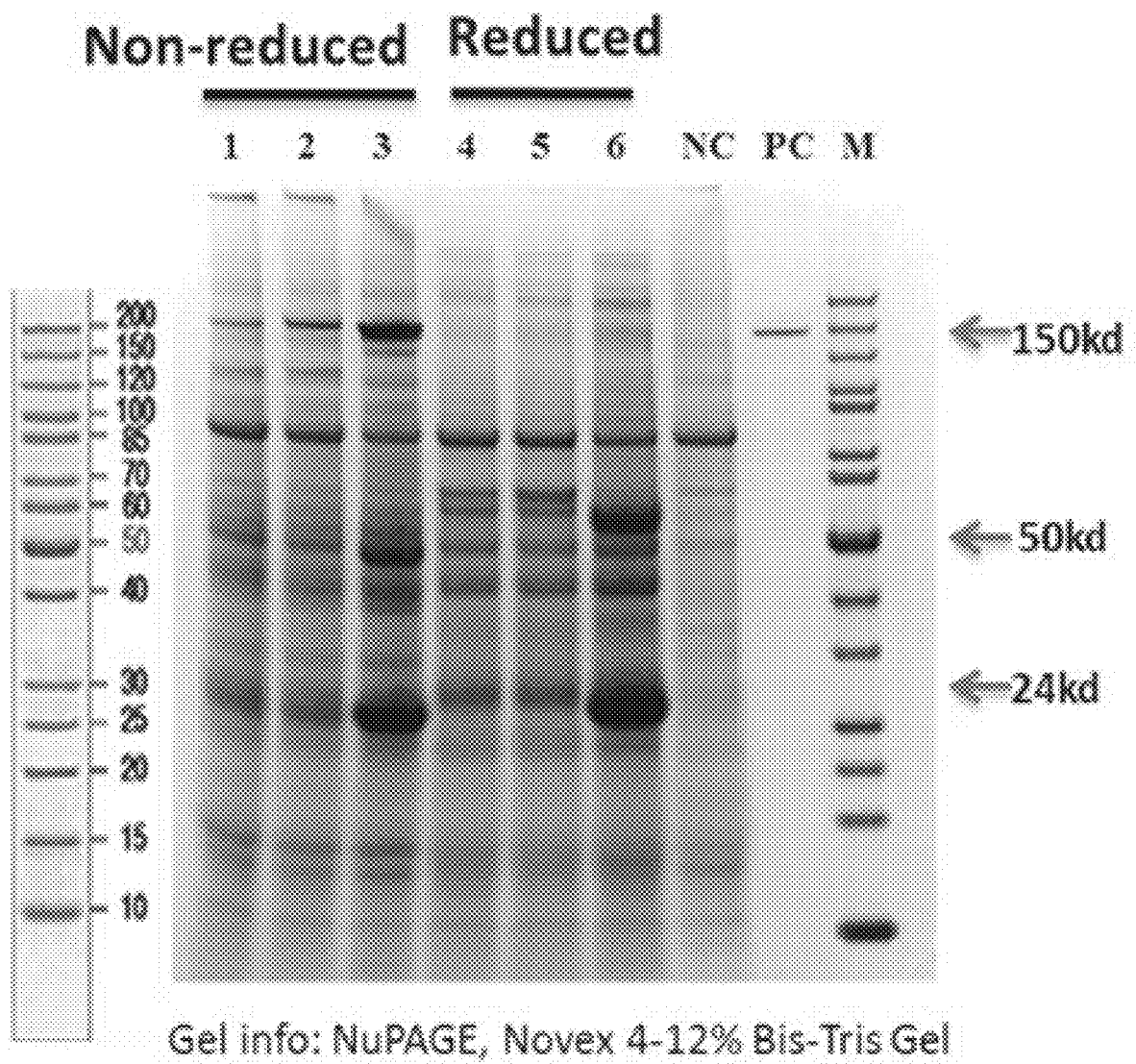
FIG. 16 shows SDS-PAGE of designed disulphide bond at pre-alpha/beta interface. Lane 1 and Lane 2 are "Design_5 Pre_TCR_Conjunction'1_Cys13" and "Design_6_Pre_TCR_Conjunction'1_Cys14", respectively, treated in non-reduced condition. Lane 4 and lane 5 are "Design_5 Pre_TCR_Conjunction'1_Cys13" and "Design_6_Pre_TCR_Conjunction'1_Cys14", respectively, treated in reduced condition.
Figures 17A, 17B:
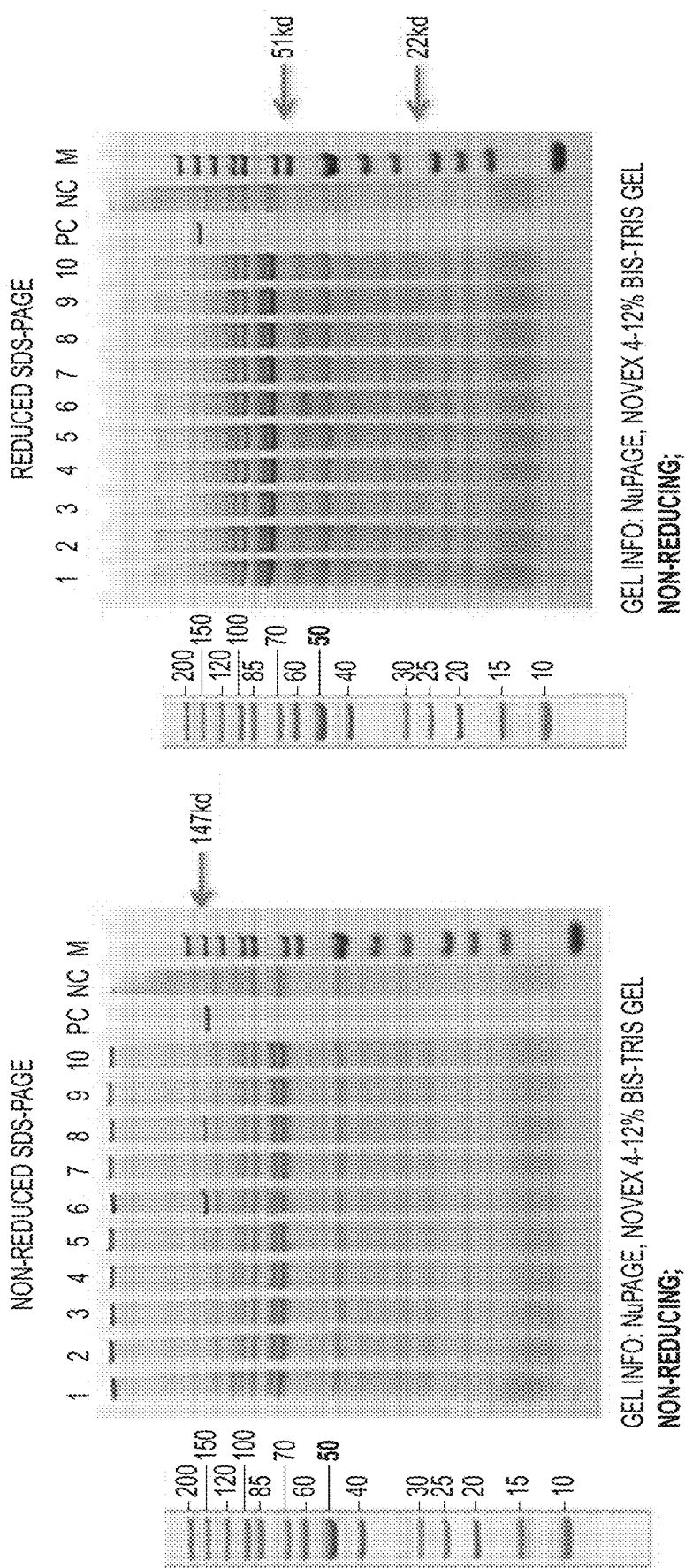
FIGS. 17A-17B show SDS-PAGE of designed disulphide bond at delta/gamma interface. Lane 6 and lane 8 are "Design_2_Cys5 no_Glyco" and "Design_2_hypeCys2no_Glyco", respectively.

To determine whether the disulphide bonds play a role in maintaining the WuXiBody structures, constructs with and/or without disulphide bonds in the TCR constant region of the chimeric antibodies were expressed. SDS-PAGE results of the expressed WuXiBody were shown in FIGS. 15-17. All the WuXiBody expressed were whole IgG-like construct with two identical arms. Expression of constructs with and without cysteine mutations between S56 in CBeta and T49 in CAlpha, expression of constructs with cysteine mutations between S16 or A18 in CBeta and S11 in CPre-Alpha, between Q57 in CGamma and V50 in CDelta, and between A19 in CGamma and E88 in CDelta were tested.

Figures 15A, 15B:
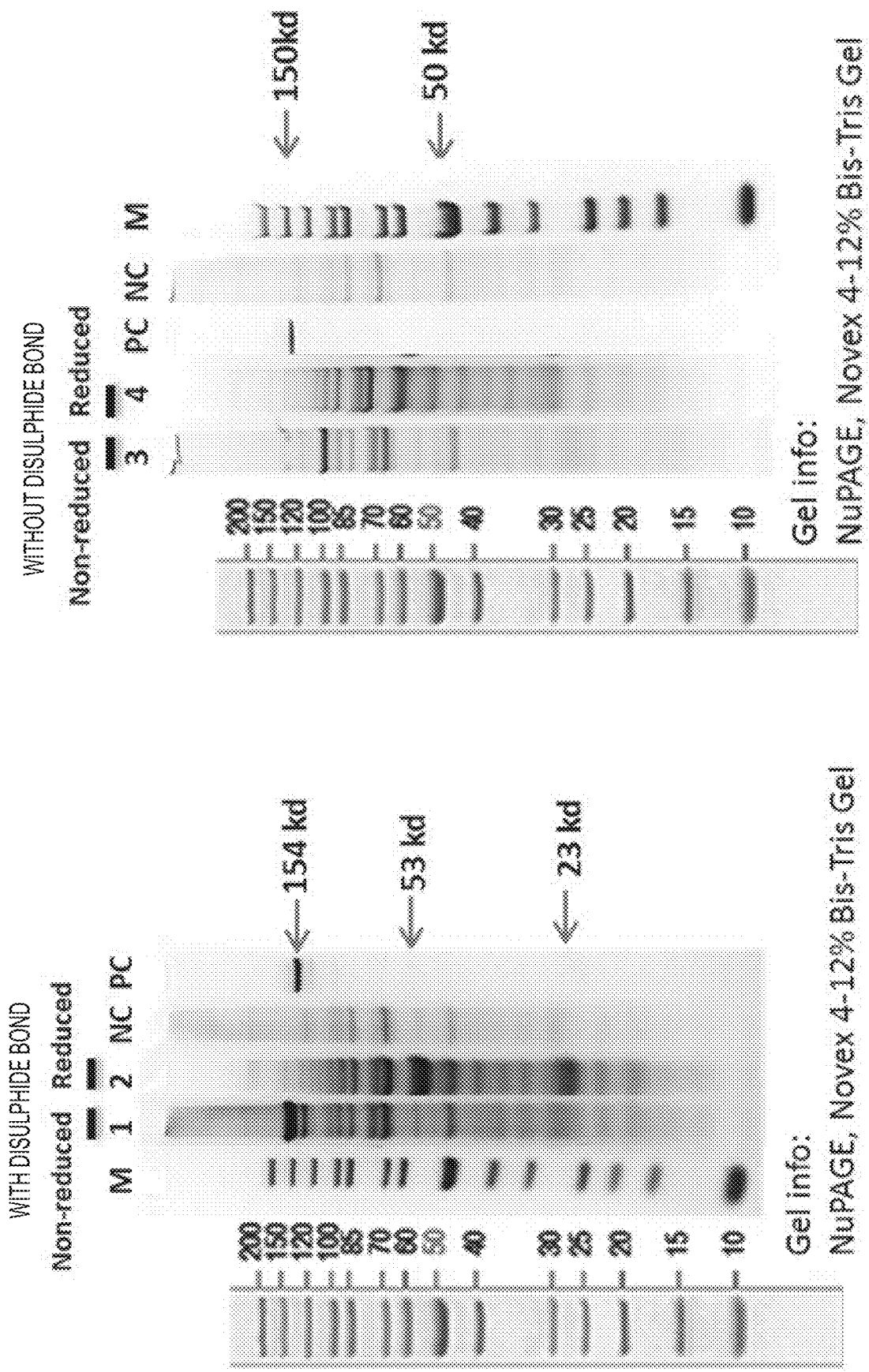
FIGS. 15A-15B show the role of interchain disulphide bond in antibody expression at alpha/beta interface characterized by SDS-PAGE.

The result of constructs expression with disulphide bond absent in CBeta/CAlpha (SEQ ID NOs: 32/42) indicates that constructs absent of disulphide bonds were unable to maintain the antibody structure (see FIG. 15B). Expression of constructs with disulphide bond absent in CBeta/CPre-Alpha and CGamma/CDelta was also tested and show similar results. In contrast, constructs containing mutated cysteine residues were able to form interchain disulphide bonds, which were capable of maintaining the Ig-like structures (see FIG. 15A).

Design Chimeric Domains of WuXibody

The cysteine pair mutations (numbering in reference of the sequences in FIGS. 19A-19E) in the TCR constant regions were incorporated into different construct designs for the TCR chimeric antibodies, which were shown in Table 21.

region. However, structurally, these two residues are already part of the conjunction. We defined our conjunctions based on structure rather than sequence.

TABLE 21

Paired Cys mutations to introduce interchain disulphide bond

| Alpha-Beta | PreAlpha-Beta | | Delta-Gamma | |
|---|---|---|---|---|
| Cys Pair Mutations | Cys Pair Mutations | Corresponding Protein Name SEQ ID NOs. in HC/LC | Cys Pair Mutations | Corresponding Protein Name SEQ ID NO. in HC/LC |
| Y11-S16 | S11-S16 | Design_5_Pre_TCR_Conjunction'1_Cys13 SEQ ID NOs: 70/71 | F12-S17 | Design_2_Cys2_no_Glyco SEQ ID NOs: 96/95 |
| L13-F13 | S11-A18 | Design_6_Pre_TCR_Conjunction'1_Cys14 SEQ ID NOs: 72/71 | F12-E20 | Design_2_Cys3_no_Glyco SEQ ID NOs: 99/95 |
| L13-S16 | S11-E19 | Design_7_Pre_TCR_Conjunction'1_Cys15 SEQ ID NOs: 73/71 | M14-F14 | Design_2_Cys1_no_Glyco SEQ ID NOs: 98/97 |
| S16-V12 | A13-F13 | Design_3_Pre_TCR_Conjunction'1_Cys11 SEQ ID NOs: 69/68 | N16-T12 | Design_2_hypeCys1_no_Glyco SEQ ID NOs: 90/89 |
| S16-E14 | A13-S16 | Design_4_Pre_TCR_Conjunction'1_Cys12 SEQ ID NOs: 70/68 | D46-M62 | Design_2_hypeCys3_no_Glyco SEQ ID NOs: 94/93 |
| V23-F13 | I16-A11 | Design_10_Pre_TCR_Conjunction'1_Cys4 SEQ ID NOs: 78/77 | V50-Q57 | Design_2_hypeCys2_no_Glyco SEQ ID NOs: 92/91 |
| Y44-L62 | S62-S56 | Design_8_Pre_TCR_Conjunction'1_Cys1_4L4T_1 SEQ ID NOs: 75/74 | F87-A19 | Design_2_Cys4_no_Glyco SEQ ID NOs:101/100 |
| T46-D58 | T65-S56 | Design_9_Pre_TCR_Conjunction'1_Cys2_4L4T_2 SEQ ID NOs: 75/76 | E88-A19 | Design_2_Cys5_no_Glyco SEQ ID NOs: 101/102 |
| T46-S76 | Y59-S76 | Design_2_Pre_TCR_Conjunction'1_Cys10 SEQ ID NOs: 67/66 | | |
| T49-S56 | | | | |
| L51-S56 | | | | |
| S62-S56 | | | | |
| S62-R78 | | | | |

For paired Cys mutations in TCR Alpha-Beta constant regions, T49C-S56C disulphide bond was used for all the designs.

Figure 2B:
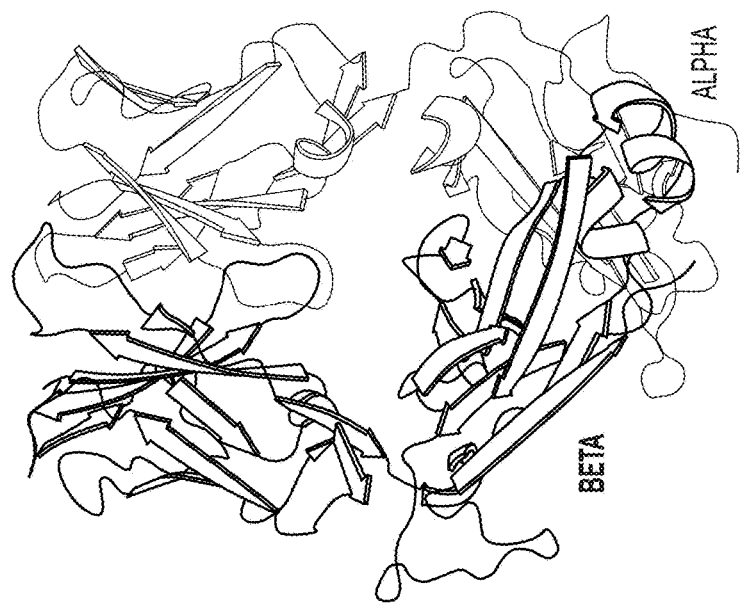
Figure 2A:
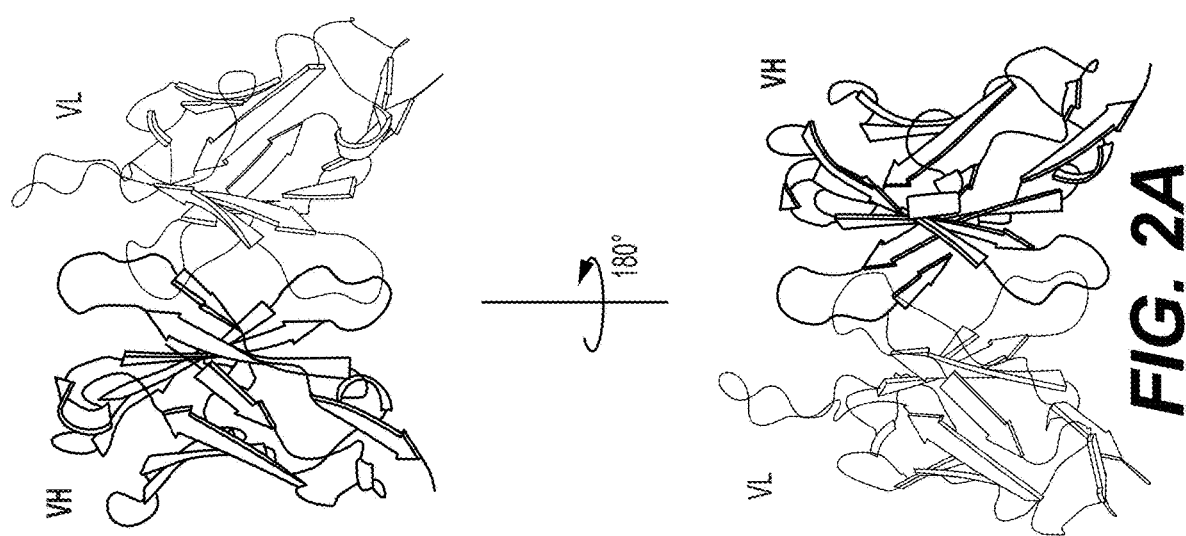

The conjunctions connecting antibody variable and TCR constant domains, their relative fusion orientations, as well as the Fc-connecting conjunctions were all carefully fine-turned to make a stable and functional WuXiBody. As TCR structure is very similar to antibody Fab, we superimposed the antibody Fv homology model on TCR variable region (PDB 4L4T, FIG. 2B). The superimposed structure indicates that antibody Fv is structurally compatible with TCR constant domain. Based on this structural alignment and corresponding sequences, all the relevant engineering parameters were designed, as illustrated below.

Domain Orientation

As the fusion orientations of both VH-CBeta/VL-CAlpha and the crossed VH-CAlpha/VL-CBeta could correctly assemble the chimeric protein, we designed and tested both orientations. The sequence homology of VH-VL is closer to the TCR VBeta-VAlpha. We named VH-CBeta/VL-CAlpha formulas as "normal orientation", and the VH-CAlpha/VL-CBeta as "crossed orientation".

First and Second Conjunction Domains

We aligned the sequences of antibody and TCR based on structure alignment, and found the conjunctions defined in germline sequence are not always consistent to what it displays on the structure. For example, from sequence definition, the conjunctions connecting VH and the CH1 should start right after the last two residues "SS" in VH Table 1 and Table 2 in the present disclosure showed the structure-based sequence alignment for two studied orientations. As it was challenging to predict which domain would be compatible with which conjunction domain, we checked how antibody and TCR conjunctions overlapped on the superimposed structures, and estimated the possible replacement using one to the other. The designs of the conjunction domains were listed in Table 1 and Table 2.

Third Conjunction Domains

Similar strategy as described above was used to align the human IgG1 and IgG4 hinge with TCR membrane proximal region (i.e. TCR hinge), and their overlap at the structural level was checked as well. Table 7 and Table 8 in the present disclosure listed designs of the third conjunction domains.

FG Loop and DE Loop

Figure 3B:
FIGS. 3A-3B show a comparison between TCR constant region and antibody Fab constant region.
Figure 3A:
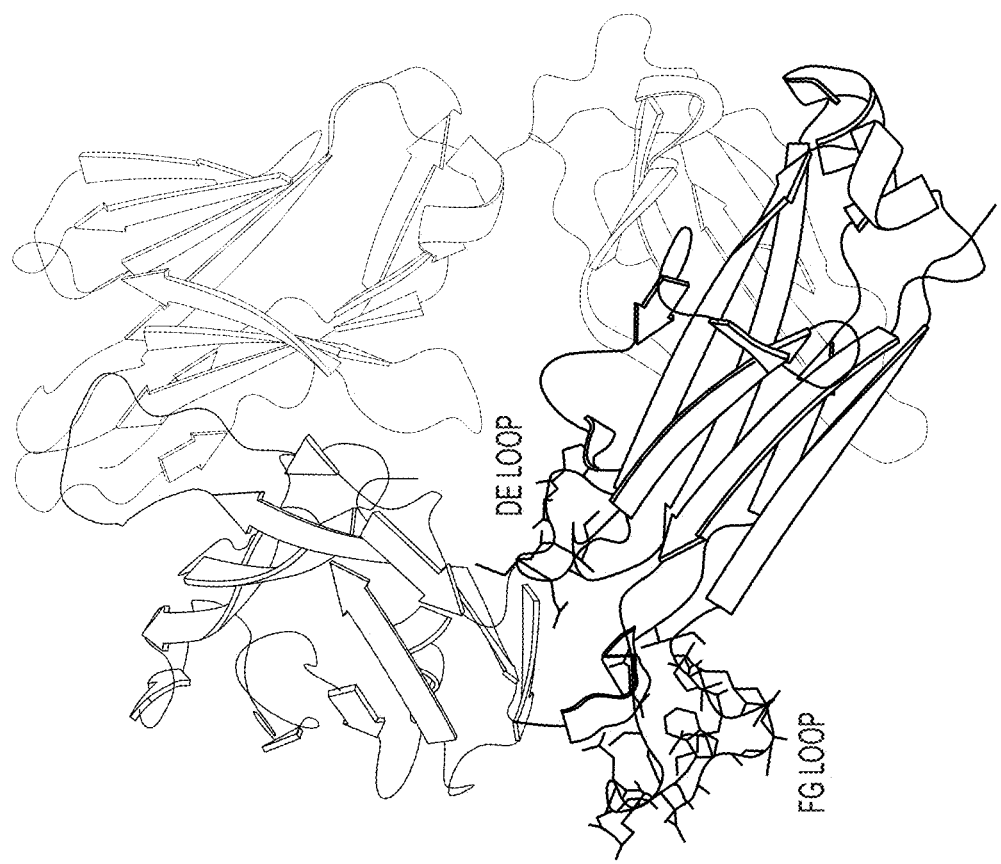

Aligning the structures of TCR constant region with that of antibody revealed that the FG and DE loop of TCR beta chain are longer than the corresponding region in antibody CH1. FIGS. 3A-3B show the differences of constant regions between T cell beta chain and antibody heavy chain. To test how these two loops could perturb the structure if CH1 was replaced by TCR beta, constructs with and without these two loops were designed.

With the above mentioned considerations, a total of nine constructs were designed by combining these parameters as listed in Table 22 and Table 23.

TABLE 22

Design of chimeric proteins (CBeta/CAlpha) of WuXiBody

| SEQ ID NOs: (Heavy Chain (HC)/ Light Chain (LC))-IgG1 | Orientation | Conjunction | Conjunction' | FG loop | DE loop |
|---|---|---|---|---|---|
| Design_1 SEQ ID NO: 2/1 | Normal | Conjunction_1 | Conjunction'_1 (IgG1, IgG4) | Native | Native |
| Design_2 SEQ ID NO: 4/3 | Normal | Conjunction_2 | Conjunction'_1 (IgG1, IgG4) | Native | Native |
| Design_3 SEQ ID NO: 9/8 | Cross | Conjunction_3 | Conjunction'_2 (IgG1, IgG4) | Native | Native |
| Design_4 SEQ ID NO: 10/8 | Cross | Conjunction_4 | Conjunction'_2 (IgG1, IgG4) | Native | Native |
| Design_5 SEQ ID NO: 5/1 | Normal | Conjunction_1 | Conjunction'_1 (IgG1, IgG4) | Replaced | Native |
| Design_6 SEQ ID NO: 6/3 | Normal | Conjunction_2 | Conjunction'_1 (IgG1, IgG4) | Replaced | Native |
| Design_6a SEQ ID NO: 7/3 | Normal | Conjunction_2 | Conjunction'_1 (IgG1, IgG4) | Replaced | Replaced |
| Design_7 SEQ ID NO: 9/11 | Cross | Conjunction_3 | Conjunction'_2 (IgG1, IgG4) | Replaced | Native |
| Design_8 SEQ ID NO: 10/11 | Cross | Conjunction_4 | Conjunction'_2 (IgG1, IgG4) | Replaced | Native |

TABLE 23

Components and sequences of chimeric proteins (CBeta/CAlpha) of WuXiBody

| | Domains from N-terminal to C-terminal and their SEQ ID NOs | | | | |
|---|---|---|---|---|---|
| Complex name and chain SEQ ID NOs: | Antibody Heavy Chain Variable Domain (VH or VL) | First or Second Conjunction domain (CJ) | TCR Constant Domain (C1 or C2) | Third Conjunction domain + Hinge (CJ') | Dimerization Domain (D) |
| Design_1 HC SEQ ID NO: 2 | VH(CD3) SEQ ID NO: 300 | HCJ1 SEQ ID NO: 49 | Cbeta(S56C) SEQ ID NO: 33 | CJ'1G1 SEQ ID NO: 53 | FcG1 SEQ ID NO: 302 |
| Design_1 LC SEQ ID NO: 1 | VL(CD3) SEQ ID NO: 301 | LCJ1 SEQ ID NO: 51 | CAlpha(T49C) SEQ ID NO: 43 | | |
| Design_2 HC SEQ ID NO: 4 | VH(CD3) SEQ ID NO: 300 | HCJ2 SEQ ID NO: 50 | Cbeta(S56C) SEQ ID NO: 33 | CJ'1G1 SEQ ID NO: 53 | FcG1 SEQ ID NO: 302 |
| Design_2 LC SEQ ID NO: 3 | VL(CD3) SEQ ID NO: 301 | LCJ2 SEQ ID NO: 52 | CAlpha(T49C) SEQ ID NO: 43 | | |
| Design_3 HC SEQ ID NO: 9 | VH(CD3) SEQ ID NO: 300 | HCJ3 SEQ ID NO: 129 | CAlpha(T49C) SEQ ID NO: 43 | CJ'2G1 SEQ ID NO: 134 | FcG1 SEQ ID NO: 302 |
| Design_3 LC SEQ ID NO: 8 | VL(CD3) SEQ ID NO: 301 | LCJ3 SEQ ID NO: 308 | Cbeta(S56C) SEQ ID NO: 33 + NO: 306 | | |
| Design_4 HC SEQ ID NO: 10 | VH(CD3) SEQ ID NO: 300 | HCJ4 SEQ ID NO: 130 | CAlpha(T49C) SEQ ID NO: 43 | CJ'2G1 SEQ ID NO: 134 | FcG1 SEQ ID NO: 302 |
| Design_4 LC SEQ ID NO: 8 | VL(CD3) SEQ ID NO: 301 | LCJ3 SEQ ID NO: 308 | Cbeta(S56C) SEQ ID NO: 33 + NO: 306 | | |
| Design_5 HC SEQ ID NO: 5 | VH(CD3) SEQ ID NO: 300 | HCJ1 SEQ ID NO: 49 | Cbeta(S56C) (FG-) SEQ ID NO: 37 | CJ'1G1 SEQ ID NO: 53 | FcG1 SEQ ID NO: 302 |
| Design_5 LC SEQ ID NO: 1 | VL(CD3) SEQ ID NO: 301 | LCJ1 SEQ ID NO: 51 | CAlpha(T49C) SEQ ID NO: 43 | | |
| Design_6 HC SEQ ID NO: 6 | VH(CD3) SEQ ID NO: 300 | HCJ1 SEQ ID NO: 50 | CBeta(S56C)(FG-) SEQ ID NO: 37 | CJ'1G1 SEQ ID NO: 53 | FcG1 SEQ ID NO: 302 |
| Design_6 LC SEQ ID NO: 3 | VL(CD3) SEQ ID NO: 301 | LCJ2 SEQ ID NO: 52 | CAlpha(T49C) SEQ ID NO: 43 | | |
| Design_6a HC SEQ ID NO: 7 | VH(CD3) SEQ ID NO: 300 | HCJ2 SEQ ID NO: 50 | CBeta(S56C)(DE-FG-) SEQ ID NO: 41 | CJ'1G1 SEQ ID NO: 53 | FcG1 SEQ ID NO: 302 |
| Design_6a LC SEQ ID NO: 3 | VL(CD3) SEQ ID NO: 301 | LCJ2 SEQ ID NO: 52 | CAlpha(T49C) SEQ ID NO: 43 | | |
| Design_7 HC SEQ ID NO: 9 | VH(CD3) SEQ ID NO: 300 | HCJ3 SEQ ID NO: 129 | CAlpha(T49C) SEQ ID NO: 43 | CJ'2G1 SEQ ID NO: 134 | FcG1 SEQ ID NO: 302 |
| Design_7 LC SEQ ID NO: 11 | VL(CD3) SEQ ID NO: 301 | LCJ3 SEQ ID NO: 308 | CBeta(S56C)(FG-) SEQ ID NO: 37 + NO: 306 | | |
| Design_8 HC SEQ ID NO: 10 | VH(CD3) SEQ ID NO: 300 | HCJ4 SEQ ID NO: 130 | CAlpha(T49C) SEQ ID NO: 43 | CJ'2G1 SEQ ID NO: 134 | FcG1 SEQ ID NO: 302 |
| Design_8 LC SEQ ID NO: 11 | VL(CD3) SEQ ID NO: 301 | LCJ3 SEQ ID NO: 308 | CBeta(S56C)(FG-) SEQ ID NO: 37 + NO: 306 | | |

Example 2: Generation and Characterization of Monospecific TCR/Antibody Chimeras Before fusing TCR constant domains into bispecific antibody constructs, the feasibility of introducing them into a regular monospecific IgG was firstly evaluated. An anti-CD3 antibody developed in-house, named T3, was selected to conduct this Proof-of-Concept study. The constant domains CH1 and CL of T3 IgG were replaced by the corresponding TCR constant region (CAlpha and CBeta). All the nine different strategies listed in Table 22 (see above) were applied, and all constructs were expressed in Expi293 system.

Table 24 listed the expression level of the designed proteins in harvested supernatants quantified by Q-ELISA. In general, most of the "normal orientation" designs had better expression than the "crossed orientation" formats, and most of the "TCR conjunctions" are better than the "antibody conjunctions". Two constructs of "normal orientation", Design_5 and Design-6 had expression comparable to Design_2). For two constructs of "cross orientation", Design_7, 8 had better expression than Design_3, 4. The low expression of extra-long FG loop in TCR CBeta was observed, suggesting that this FG loop might cause significant steric clashes with fused antibody VL domain.

TABLE 24

The expression levels and CD3 binding of all the designs in supernatant

| Samples (IgG1) | Expression Level in Supernatant (ug/mL) | Concentration (nM) in FACS | | |
|---|---|---|---|---|
| | | 5.0 | 0.4 MFI | 0.032 |
| T3 | N/A | 5101 | 2937 | 408 |
| Design_1 | 72.04 | 5441 | 2190 | 292 |
| Design_2 | 204.42 | 5833 | 2616 | 380 |
| Design_3 | 15.35 | 5089 | 982 | 137 |
| Design_4 | 26.11 | 5438 | 1213 | 168 |
| Design_5 | 113.68 | 5388 | 1865 | 249 |
| Design_6 | 178.56 | 5789 | 3914 | 613 |
| Design_6a | 173.60 | 5794 | 2822 | 405 |
| Design_7 | 75.69 | 6322 | 1929 | 259 |
| Design_8 | 98.63 | 6412 | 1831 | 243 |

These results were completely different with what Wu et al. observed in their similar antibody-TCR chimeras design (Wu et al. 2015, supra): Their "crossed orientation" designs had low expression. Their "normal orientation" designs did not even express.

To confirm whether the expressed proteins had correct folding and retained the original function, we tested their binding on CD3 positive Jurkat cells. FACS bindings of all the samples were carried out at three different concentrations: 5.0, 0.4 and 0.032 nm. The original wild type antibody T3 was used as the positive control. The dose-dependent CD3 binding data was listed in column 3-5 in Table 24. Design_2, Design_6 and Design_6a showed best binding capability, comparable to native antibody T3. It is interesting that all these three constructs happened to be the best three expressed formats in mammalian cell. This strong correlation suggested that the level of expression or binding might result from the same molecular origin, i.e., the compatibility between antibody variable domain and TCR constant domains, which required careful designs of the components such as conjunction domains and interchain disulphide bond etc.

Based on the expression level and binding activity, Design_2 was selected as the final format to proceed.

Example 3: De-Glycosylation

Post translational modifications (PTM) like N-glycosylation sites on an antibody may cause heterogeneity of the proteins, becoming a challenge in development stages. Therefore, an attempt was conducted to remove the N-glycosylation sites on TCR constant region. There are total four N-glycosylation sites found in the TCR constant region. One is on CBeta (N69, see SEQ ID NO: 244), and the other three are on CAlpha (N34, N68 and N79, see SEQ ID NO: 241). The expression data of the present disclosure suggested that these sites, especially the sites on CAlpha, were indeed heavily glycosylated when the molecule was expressed in mammalian cell.

All the glycosylation sites on Design_2 were removed by substituting four Asn residues with Gln or Ala (refer to Design_2-QQQQ or -AAAA, see Table 25). Although this strategy is very general in protein engineering, it has been reported that Gln/Ala mutations may affect the expression level of TCR/antibody chimeric proteins (Wu et al., 2015, supra). To mitigate this risk, residues from Pre-TCR (N68S on CAlpha) and macaca TCR (N79 on CAlpha, N69E on CBeta) at the corresponding positions (refer to Design_2-QSKE and -ASKE) were also used (see Table 25). In addition, it was reported that there may exist an atypical glycosylation site on CAlpha (N61) (Wollscheid et al., Nature Biotechnology, 27(4), pp. 378-386 (2009) "Mass-spectrometric identification and relative quantification of N-linked cell surface glycoproteins." Wollscheid B., Bausch-Fluck D., Henderson C., O'Brien R., Bibel M., Schiess R., Aebersold R., Watts J. D., Nat. Biotechnol. 27:378-386(2009) [PubMed] [Europe PMC]). Therefore, this residue was also mutated to Gln (refer to Design_2-QQQQQ, see Table 25). All mutants were expressed in Expi293 for further tests.

TABLE 25

The expression levels of all the de-glycosylation designs in supernatant

| Sample | Expression Level in Supernatant (ug/mL) | SEQ ID NO: (HC-CBeta/LC-CAlpha) |
|---|---|---|
| Design_2-QQQQ | 334.39 | 13/12 (IgG1) |
| | | 21/12(IgG4) |
| Design_2-AAAA | 414.58 | 15/14 (IgG1) |
| Design_2-QSKE | 311.48 | 17/16 (IgG1) |
| Design_2-ASKE | 107.89 | 17/18 (IgG1) |
| Design_2-QQQQQ | 213.31 | 20/19 (IgG1) |

TABLE 26

Components of the de-glycosylation designs

| Complex name and chain SEQ ID NOs: | Antibody Heavy Chain Variable Domain (VH or VL) | First or Second Conjunction domain (CJ) | TCR Constant Domain (C1 or C2) | Third Conjunction domain + Hinge (CJ') | Dimerization Domain (D) |
|---|---|---|---|---|---|
| Design_2-QQQQ (IgG1) HC | VH(CD3) | HCJ2 | CBeta(S56C) (N69Q) | CJ'1G1 | FcG1 |
| SEQ ID NO: 13 | SEQ ID NO: 300 | SEQ ID NO: 50 | SEQ ID NO: 34 | SEQ ID NO: 53 | SEQ ID NO: 302 |
| Design_2-QQQQ (IgG1) LC | VL(CD3) | LCJ2 | CAlpha(T49C) (N34Q + N68Q + N79Q) | | |
| SEQ ID NO: 12 | SEQ ID NO: 301 | SEQ ID NO: 52 | SEQ ID NO: 44 | | |
| Design_2-QQQQ (IgG4) HC | VH(CD3) | HCJ2 | CBeta(S56C) (N69Q) | CJ'1G4 | FcG4 |
| SEQ ID NO: 21 | SEQ ID NO: 300 | SEQ ID NO: 50 | SEQ ID NO: 34 | SEQ ID NO: 54 | SEQ ID NO: 303 |
| Design_2-QQQQ (IgG4) LC | VL(CD3) | LCJ2 | CAlpha(T49C) (N34Q + N68Q + N79Q) | | |
| SEQ ID NO: 12 | SEQ ID NO: 301 | SEQ ID NO: 52 | SEQ ID NO: 44 | | |
| Design_2-AAAA (IgG1) HC | VH(CD3) | HCJ2 | CBeta(S56C) (N69A) | CJ'1G1 | FcG1 |
| SEQ ID NO: 15 | SEQ ID NO: 300 | SEQ ID NO: 50 | SEQ ID NO: 35 | SEQ ID NO: 53 | SEQ ID NO: 302 |
| Design_2-AAAA (IgG1) LC | VL(CD3) | LCJ2 | CAlpha(T49C) (N34A + N68A + N79A) | | |
| SEQ ID NO: 14 | SEQ ID NO: 301 | SEQ ID NO: 52 | SEQ ID NO: 45 | | |
| Design_2-QSKE (IgG1) HC | VH(CD3) | HCJ2 | CBeta(S56C) (N69E) | CJ'1G1 | FcG1 |
| SEQ ID NO: 17 | SEQ ID NO: 300 | SEQ ID NO: 50 | SEQ ID NO: 36 | SEQ ID NO: 53 | SEQ ID NO: 302 |
| Design_2-QSKE (IgG1) LC | VL(CD3) | LCJ2 | CAlpha(T49C) (N34Q + N68S + N79K) | | |
| SEQ ID NO: 16 | SEQ ID NO: 301 | SEQ ID NO: 52 | SEQ ID NO: 46 | | |
| Design_2-ASKE (IgG1) HC | VH(CD3) | HCJ2 | CBeta(S56C) (N69E) | CJ'1G1 | FcG1 |
| SEQ ID NO: 17 | SEQ ID NO: 300 | SEQ ID NO: 50 | SEQ ID NO: 36 | SEQ ID NO: 53 | SEQ ID NO: 302 |
| Design_2-ASKE (IgG1) LC | VL(CD3) | LCJ2 | CAlpha(T49C) (N34A + N68S + N79K) | | |
| SEQ ID NO: 18 | SEQ ID NO: 301 | SEQ ID NO: 52 | SEQ ID NO: 47 | | |
| Design_2-QQQQQ (IgG1) HC | VH(CD3) | HCJ2 | CBeta(S56C) (N69Q) | CJ'1G1 | FcG1 |
| SEQ ID NO: 20 | SEQ ID NO: 300 | SEQ ID NO: 50 | SEQ ID NO: 34 | SEQ ID NO: 53 | SEQ ID NO: 302 |
| Design_2-QQQQQ (IgG1) LC | VL(CD3) | LCJ2 | CAlpha(T49C) (N34Q + N68Q + N79Q + N61Q) | | |
| SEQ ID NO: 19 | SEQ ID NO: 301 | SEQ ID NO: 52 | SEQ ID NO: 48 | | |

Figure 4:
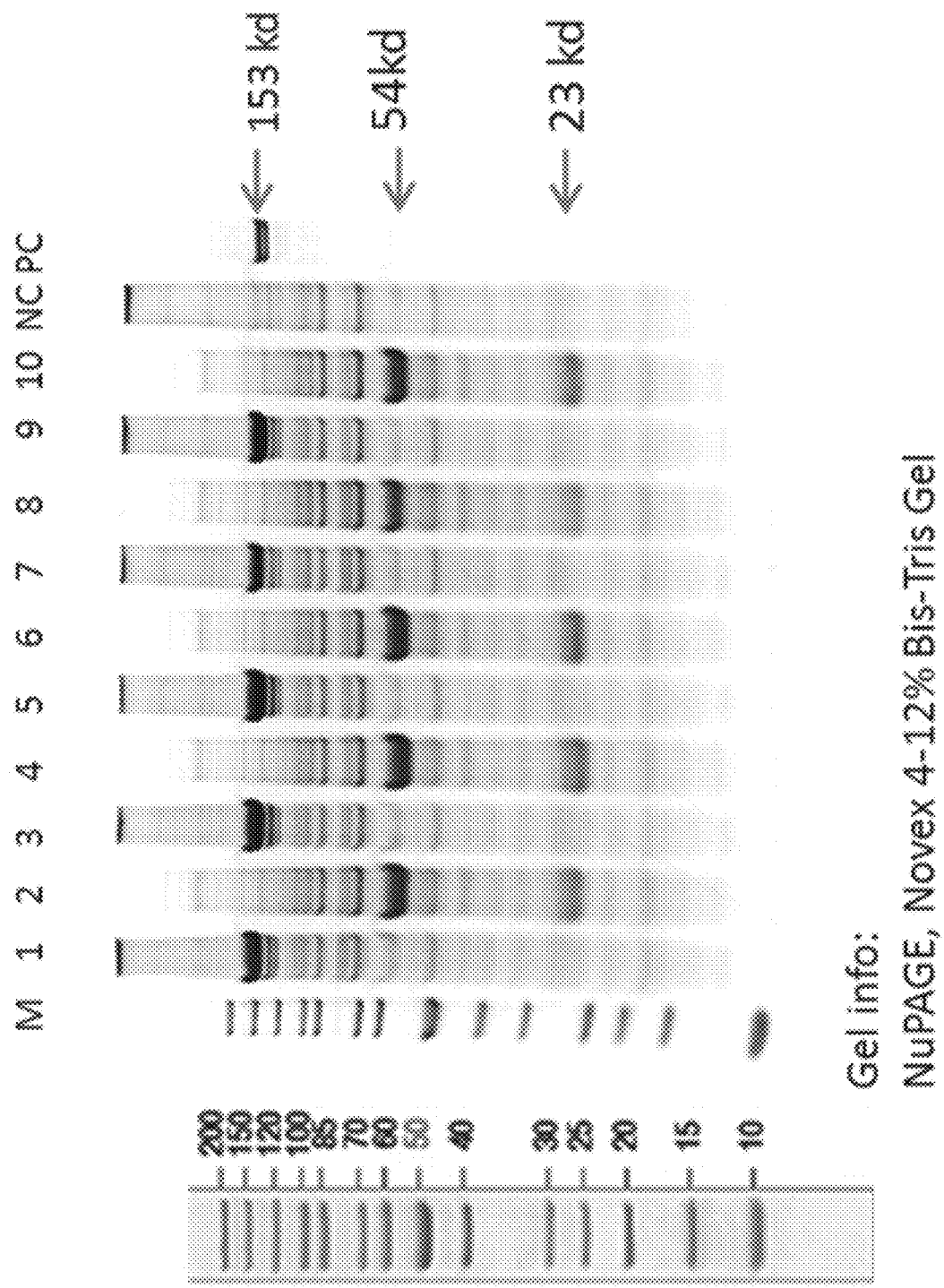
FIG. 4 shows SDS-PAGE results of the de-glycosylation mutants of TCR-antibody chimeric antibodies with CAlpha and CBeta chains. Samples were all harvested supernatants from the production of Expi293 expressions. Lanes 1, 3, 5, 7 and 9 are the non-reduced pages of Design_2-QQQQ, Design_2-AAAA, Design_2-QSKE, Design_2-ASKE and Design_2-QQQQQ, respectively. Lanes 2, 4, 6, 8 and 10 are the corresponding reduced pages.
Figure 5:
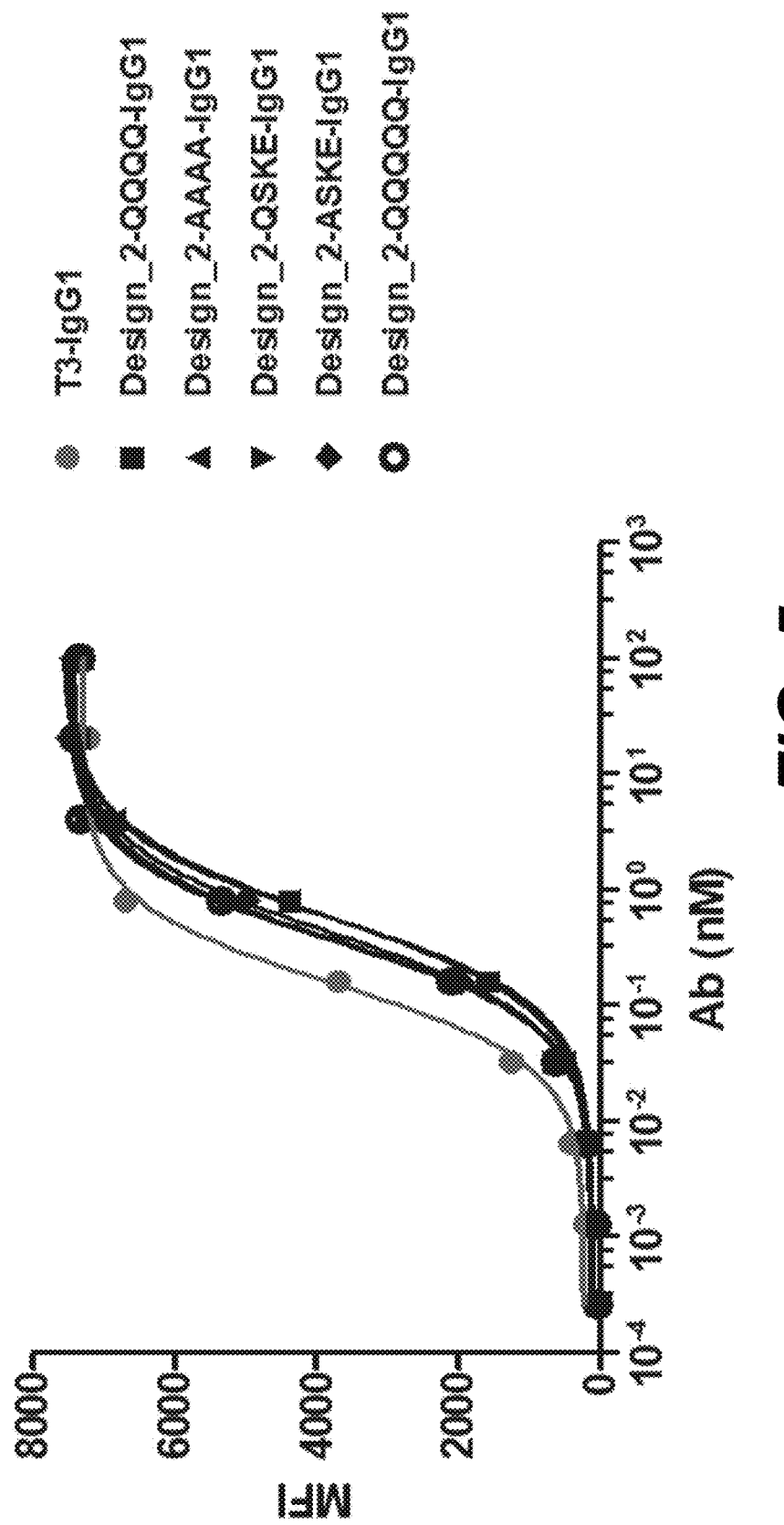
FIG. 5 shows dose-dependent FACS bindings of all the de-glycosylated mutants binding to CD3-expressed Jurkat cells. All samples were harvested supernatants of the de-glycosylation mutants expressed in Expi293. The wild type anti-CD3 antibody (T3-IgG1) was used as the positive control.

The expression quantities in supernatants were estimated by Q-ELISA shown in Table 25. Interestingly, only one of our de-glycosylation designs slightly decreased expression level. Simple mutations by Gln or Ala did not have any negative effects on the non-reduced gel (FIG. 4), and 150 kd band was observed. On the reduced gel (FIG. 4), the 25 kd band was observed. Both indicate the successful removal of glycosylation on light chain and heavy chain. The muteins with the removal of N-glycans on TCR constant region were tested on CD3-binding. FIG. 5 showed the different muteins binding on CD3+ Jurkat cells. The curves of muteins only slightly shifted to the right compared to the wild type antibody T3, which might be due to detection antibody being more sensitive to human IgG than chimera. The maximum binding did not change. Overall, most of the de-glycosylation designs did not exhibit any obvious differences in either expression or binding. Design_2-QQQQ was chosen as the design for further studies.

In the similar study conducted by Wu et al., (Wu et al. 2015, supra), they performed de-glycosylation mutations on their "crossed orientation" formats, as their "normal orientation" formats did not express.

Example 4: Design of TCR Pre-Alpha/Beta Based WuXiBody

The pre-T-cell antigen receptor (pre-TCR), expressed by immature thymocytes, has a pivotal role in early T-cell development. Pre-TCR has a regular beta chain, but a special pre-alpha chain with only constant region available, whose sequence and structure are quite distinct from those of regular alpha chain. Since the constant region of regular TCR is compatible with antibody variable region, the Pre-TCR (see PDB 3OF6, SEQ ID NO: 246) was expected to help design chimeric protein, too. The antibody designs were shown in Table 27.

TABLE 27

Design of TCR pre-alpha/beta based chimeras for WuXiBody

| | Orientation | Conjunction | Conjunction' | FG loop | DE loop |
|---|---|---|---|---|---|
| PreTCR_Design_A | Normal | Conjunction_A | Conjunction'_1 (IgG1, IgG4) | Native | Native |
| PreTCR_Design_B | Normal | Conjunction_B | Conjunction'_1 (IgG1, IgG4) | Native | Native |
| PreTCR_Design_C | Cross | Conjunction_C | Conjunction'_2 (IgG1, IgG4) | Native | Native |
| PreTCR_Design_D | Cross | Conjunction_D | Conjunction'_2 (IgG1, IgG4) | Native | Native |

Total ten chimeric constructs were designed by combining these parameters, as listed in Table 28.

TABLE 28

Correspondence of the design of chimeric Pre-TCR-antibody chimeric in IgG1 form

| Designs in Table 27 | Sequence file | SEQ ID NOs: (HC/LC) |
|---|---|---|
| PreTCR_Design_B | Design_1_Pre_TCR_Conjunction'1 | 65/64 |
| | Design_2_Pre_TCR_Conjunction'_1_Cys10 | 67/66 |
| | Design_3_Pre_TCR_Conjunction'_1_Cys11 | 69/68 |
| | Design_4_Pre_TCR_Conjunction'_1_Cys12 | 70/68 |
| | Design_5_Pre_TCR_Conjunction'_1_Cys13 | 70/71 |
| | Design_6_Pre_TCR_Conjunction'_1_Cys14 | 72/71 |
| | Design_7_Pre_TCR_Conjunction'_1_Cys15 | 73/71 |
| | Design_8_Pre_TCR_Conjunction'_1_Cys1_4L4T_1 | 75/74 |
| | Design_9_Pre_TCR_Conjunction'_1_Cys2_4L4T_2 | 75/76 |
| | Design_10_Pre_TCR_Conjunction'_1_Cys4 | 78/77 |
| PreTCR_Design_C | PreTCR_Design_5_crossed_1 | 137/136 |
| | PreTCR_Design_6_crossed_1 | 137/139 |
| PreTCR_Design_D | PreTCR_Design_5_crossed_2 | 138/136 |
| | PreTCR_Design_6_crossed_2 | 138/139 |

TABLE 29

Components of the design of chimeric Pre-TCR-antibody chimeric in IgG1 form

| Complex name and chain SEQ ID NOs: | Antibody Heavy Chain Variable Domain (VH or VL) | First or Second Conjunction domain (CJ) | TCR Constant Domain (C1 or C2) |
|---|---|---|---|
| Design_1_Pre_TCR_Conjunction'1 HC SEQ ID NO: 65 | VH(CD3) SEQ ID NO: 300 | HCJB SEQ ID NO: 50 | CBeta(N69Q) SEQ ID NO: 84 |
| Design_1_Pre_TCR_Conjunction'1 LC SEQ ID NO: 64 | VL(CD3) SEQ ID NO: 301 | LCJB SEQ ID NO: 309 | CPreAlpha(N50Q) SEQ ID NO: 83 |
| Design_2_Pre_TCR_Conjunction'_1_Cys10 HC SEQ ID NO: 67 | VH(CD3) SEQ ID NO: 300 | HCJB SEQ ID NO: 50 | Cbeta(S76C)(N69Q) SEQ ID NO: 319 |
| Design_2_Pre_TCR_Conjunction'_1_Cys10 LC SEQ ID NO: 66 | VL(CD3) SEQ ID NO: 301 | LCJB SEQ ID NO: 309 | CPreAlpha (Y59C)(N50Q) SEQ ID NO: 311 |
| Design_3_Pre_TCR_Conjunction'_1_Cys11 HC SEQ ID NO: 69 | VH(CD3) SEQ ID NO: 300 | HCJB SEQ ID NO: 50 | Cbeta(F13C)(N69Q) SEQ ID NO: 320 |
| Design_3_Pre_TCR_Conjunction'_1_Cys11 LC SEQ ID NO: 68 | VL(CD3) SEQ ID NO: 301 | LCJB SEQ ID NO: 309 | CPreAlpha (A13C)(N50Q) SEQ ID NO: 312 |
| Design_4_Pre_TCR_Conjunction'_1_Cys12 HC SEQ ID NO: 70 | VH(CD3) SEQ ID NO: 300 | HCJB SEQ ID NO: 50 | Cbeta(S16C)(N69Q) SEQ ID NO: 321 |
| Design_4_Pre_TCR_Conjunction'_1_Cys12 LC SEQ ID NO: 68 | VL(CD3) SEQ ID NO: 301 | LCJB SEQ ID NO: 309 | CPreAlpha (A13C)(N50Q) SEQ ID NO: 312 |
| Design_5_Pre_TCR_Conjunction'_1_Cys13 HC SEQ ID NO: 70 | VH(CD3) SEQ ID NO: 300 | HCJB SEQ ID NO: 50 | Cbeta(S16C)(N69Q) SEQ ID NO: 321 |
| Design_5_Pre_TCR_Conjunction'_1_Cys13 LC SEQ ID NO: 71 | VL(CD3) SEQ ID NO: 301 | LCJB SEQ ID NO: 309 | CPreAlpha (S11C)(N50Q) SEQ ID NO: 313 |
| Design_6_Pre_TCR_Conjunction'_1_Cys14 HC SEQ ID NO: 72 | VH(CD3) SEQ ID NO: 300 | HCJB SEQ ID NO: 50 | Cbeta(A18C)(N69Q) SEQ ID NO: 322 |
| Design_6_Pre_TCR_Conjunction'_1_Cys14 LC SEQ ID NO: 71 | VL(CD3) SEQ ID NO: 301 | LCJB SEQ ID NO: 309 | CPreAlpha (S11C)(N50Q) SEQ ID NO: 313 |

TABLE 29-continued

Components of the design of chimeric Pre-TCR-antibody chimeric in IgG1 form

| | | | |
|---|---|---|---|
| Design_7_Pre_TCR_Conjunction'_1_Cys15 HC SEQ ID NO: 73 | VH(CD3) SEQ ID NO: 300 | HCJB SEQ ID NO: 50 | Cbeta(E19C)(N69Q) SEQ ID NO: 323 |
| Design_7_Pre_TCR_Conjunction'_1_Cys15 LC SEQ ID NO: 71 | VL(CD3) SEQ ID NO: 301 | LCJB SEQ ID NO: 309 | CPreAlpha (S11C)(N50Q) SEQ ID NO: 313 |
| Design_8_Pre_TCR_Conjunction'_1_Cys1_4L4T_1 HC SEQ ID NO: 75 | VH(CD3) SEQ ID NO: 300 | HCJB SEQ ID NO: 50 | Cbeta(S56C)(N69Q) SEQ ID NO: 34 |
| Design_8_Pre_TCR_Conjunction'_1_Cys1_4L4T_1 LC SEQ ID NO: 74 | VL(CD3) SEQ ID NO: 301 | LCJB SEQ ID NO: 309 | CPreAlpha (S62C)(N50Q) SEQ ID NO: 314 |
| Design_9_Pre_TCR_Conjunction'_1_Cys2_4L4T_2 HC SEQ ID NO: 75 | VH(CD3) SEQ ID NO: 300 | HCJB SEQ ID NO: 50 | Cbeta(S56C)(N69Q) SEQ ID NO: 34 |
| Design_9_Pre_TCR_Conjunction'_1_Cys2_4L4T_2 LC SEQ ID NO: 76 | VL(CD3) SEQ ID NO: 301 | LCJB SEQ ID NO: 309 | CPreAlpha (T65C)(N50Q) SEQ ID NO: 315 |
| Design_10_Pre_TCR_Conjunction'_1_Cys4 HC SEQ ID NO: 78 | VH(CD3) SEQ ID NO: 300 | HCJB SEQ ID NO: 50 | Cbeta(A11C)(N69Q) SEQ ID NO: 324 |
| Design_10_Pre_TCR_Conjunction'_1_Cys4 LC SEQ ID NO: 77 | VL(CD3) SEQ ID NO: 301 | LCJB SEQ ID NO: 309 | CPreAlpha (I16C)(N50Q) SEQ ID NO: 316 |
| PreTCR_Design_5_crossed_1 HC SEQ ID NO: 137 | VH(CD3) SEQ ID NO: 300 | HCJC SEQ ID NO: 132 | CPreAlpha (S11C)(N50Q) SEQ ID NO: 313 |
| PreTCR_Design_5_crossed_1 LC SEQ ID NO: 136 | VL(CD3) SEQ ID NO: 301 | LCJC SEQ ID NO: 50 | Cbeta (N69Q, S16C) SEQ ID NO: 321 + 306 |
| PreTCR_Design_6_crossed_1 HC SEQ ID NO: 137 | VH(CD3) SEQ ID NO: 300 | HCJC SEQ ID NO: 132 | CPreAlpha (S11C)(N50Q) SEQ ID NO: 313 |
| PreTCR_Design_6_crossed_1 LC SEQ ID NO: 139 | VL(CD3) SEQ ID NO: 301 | LCJC SEQ ID NO: 50 | Cbeta(N69Q, A18C) SEQ ID NO: 322 + 306 |
| PreTCR_Design_5_crossed_2 HC SEQ ID NO: 138 | VH(CD3) SEQ ID NO: 300 | HCJD SEQ ID NO: 133 | CPreAlpha (S11C)(N50Q) SEQ ID NO: 313 |
| PreTCR_Design_5_crossed_2 LC SEQ ID NO: 136 | VL(CD3) SEQ ID NO: 301 | LCJC SEQ ID NO: 50 | Cbeta (N69Q, S16C) SEQ ID NO: NO: 321 + 306 |
| PreTCR_Design_6_crossed_2 HC SEQ ID NO: 138 | VH(CD3) SEQ ID NO: 300 | HCJD SEQ ID NO: 133 | CPreAlpha (S11C)(N50Q) SEQ ID NO: 313 |
| PreTCR_Design_6_crossed_2 LC SEQ ID NO: 139 | VL(CD3) SEQ ID NO: 301 | LCJC SEQ ID NO: 50 | Cbeta(N69Q, A18C) SEQ ID NO: 322 + 306 |

| | Domains from N-terminal to C-terminal and their SEQ ID NOs | |
|---|---|---|
| Complex name and chain SEQ ID NOs: | Third Conjunction domain + Hinge (CJ') | Dimerization Domain (D) |
| Design_1_Pre_TCR_Conjunction'1 HC SEQ ID NO: 65 Design_1_Pre_TCR_Conjunction'1 LC SEQ ID NO: 64 | CJ'1G1 SEQ ID NO: 53 | FcG1 SEQ ID NO: 302 |
| Design_2_Pre_TCR_Conjunction'_1_Cys10 HC SEQ ID NO: 67 Design_2_Pre_TCR_Conjunction'_1_Cys10 LC SEQ ID NO: 66 | CJ'1G1 SEQ ID NO: 53 | FcG1 SEQ ID NO: 302 |
| Design_3_Pre_TCR_Conjunction'_1_Cys11 HC SEQ ID NO: 69 Design_3_Pre_TCR_Conjunction'_1_Cys11 LC SEQ ID NO: 68 | CJ'1G1 SEQ ID NO: 53 | FcG1 SEQ ID NO: 302 |
| Design_4_Pre_TCR_Conjunction'_1_Cys12 HC SEQ ID NO: 70 Design_4_Pre_TCR_Conjunction'_1_Cys12 LC SEQ ID NO: 68 | CJ'1G1 SEQ ID NO: 53 | FcG1 SEQ ID NO: 302 |
| Design_5_Pre_TCR_Conjunction'_1_Cys13 HC SEQ ID NO: 70 Design_5_Pre_TCR_Conjunction'_1_Cys13 LC SEQ ID NO: 71 | CJ'1G1 SEQ ID NO: 53 | FcG1 SEQ ID NO: 302 |
| Design_6_Pre_TCR_Conjunction'_1_Cys14 HC SEQ ID NO: 72 Design_6_Pre_TCR_Conjunction'_1_Cys14 LC SEQ ID NO: 71 | CJ'1G1 SEQ ID NO: 53 | FcG1 SEQ ID NO: 302 |
| Design_7_Pre_TCR_Conjunction'_1_Cys15 HC SEQ ID NO: 73 Design_7_Pre_TCR_Conjunction'_1_Cys15 LC SEQ ID NO: 71 | CJ'1G1 SEQ ID NO: 53 | FcG1 SEQ ID NO: 302 |
| Design_8_Pre_TCR_Conjunction'_1_Cys1_4L4T_1 HC SEQ ID NO: 75 Design_8_Pre_TCR_Conjunction'_1_Cys1_4L4T_1 LC SEQ ID NO: 74 | CJ'1G1 SEQ ID NO: 53 | FcG1 SEQ ID NO: 302 |
| Design_9_Pre_TCR_Conjunction'_1_Cys2_4L4T_2 HC SEQ ID NO: 75 Design_9_Pre_TCR_Conjunction'_1_Cys2_4L4T_2 LC SEQ ID NO: 76 | CJ'1G1 SEQ ID NO: 53 | FcG1 SEQ ID NO: 302 |

TABLE 29-continued

Components of the design of chimeric Pre-TCR-antibody chimeric in IgG1 form

| | | |
|---|---|---|
| Design_10_Pre_TCR_Conjunction'_1_Cys4 HC SEQ ID NO: 78 | CJ'1G1 SEQ ID NO: 53 | FcG1 SEQ ID NO: 302 |
| Design_10_Pre_TCR_Conjunction'_1_Cys4 LC SEQ ID NO: 77 | | |
| PreTCR_Design_5_crossed_1 HC SEQ ID NO: 137 | CJ'2G1 SEQ ID NO: 134 | FcG1 SEQ ID NO: 302 |
| PreTCR_Design_5_crossed_1 LC SEQ ID NO: 136 | | |
| PreTCR_Design_6_crossed_1 HC SEQ ID NO: 137 | CJ'2G4 SEQ ID NO: 134 | FcG4 SEQ ID NO: 303 |
| PreTCR_Design_6_crossed_1 LC SEQ ID NO: 139 | | |
| PreTCR_Design_5_crossed_2 HC SEQ ID NO: 138 | CJ'2G1 SEQ ID NO: 134 | FcG1 SEQ ID NO: 302 |
| PreTCR_Design_5_crossed_2 LC SEQ ID NO: 136 | | |
| PreTCR_Design_6_crossed_2 HC SEQ ID NO: 138 | CJ'2G1 SEQ ID NO: 134 | FcG1 SEQ ID NO: 302 |
| PreTCR_Design_6_crossed_2 LC SEQ ID NO: 139 | | |

The experience learned in Examples 1-3 suggested that "normal orientation" and the conjunction domain with more TCR residues was more suitable in producing good chimeric proteins. Thus, the same strategy was adopted and the light chain and heavy chain conjunction domains as shown in Table 3 and Table 4 were designed. Different from regular alpha chain, there is only one glycosylation site (N50) in the TCR pre-alpha chain, which was mutated to Gln residue (see SEQ ID NO: 247). The entire heavy chain with beta constant region was the same as that of Design_2 in Table 22, with N-glycosylation site (N69) substituted to Gln residue (see SEQ ID NO: 244).

The third conjunction domains in normal orientation were designed identical to that in Table 7, and the third conjunction domains in cross orientation were designed identical to that in Table 8 (TCR alpha/beta based chimeric antibodies).

Pre-TCR does not have native interchain disulphide bond above the third conjunction domain. Similar to the engineering work conducted on regular TCR, we rationally introduced disulphide bond at the beta and pre-alpha interface in the constant region to improve the stability of the chimeric protein (see Table 11). All the interfacial residues on pre-TCR crystal structure (PDB 3OF6) were inspected and the list of interchain pairs was obtained whose CAlpha and CBeta carbon atoms were within 7 Å and 5 Å, respectively (see Table 11). Each identified pair was then substituted to Cys residues and the mutein was expressed in Expi293 cells.

Example 5: Design of TCR Gamma/Delta Based Chimeric Antibodies

TCRs that are made up of gamma and delta chain are less common, but the heterodimeric nature of the protein could also help design new chimeric format. Following the same strategy and procedure that were validated in Example 1, we conducted new chimeric designs that used the constant region of delta-gamma TCR to replace the corresponding region of antibody. The structure of delta-gamma TCR (PDB 4LFH, see SEQ ID NO: 249 and 252) was used to facilitate the structure-guided sequence alignment between antibody and TCR.

Table 5 and Table 6 listed designed conjunction domains for "normal orientation" and "crossed orientation", respectively. The corresponding IgG1 and IgG4 conjunction domains of different orientations were shown in Table 9 and Table 10. The structure of delta-gamma TCR is more similar to antibody, rather than that of alpha-beta TCR. No additional FG and DE loop designs were performed. N-glycosylation sites (N65 on gamma, and N16 and N79 on delta, see SEQ ID NO: 250) were all removed by Gln (Q) substitutions. The contact interface disulphide bond was designed based on the same strategy introduced in Example 4.

TABLE 30

Design of chimeric TCR/antibody

| | Orientation | First and second conjunction domain | Third conjunction domain | FG loop | DE loop |
|---|---|---|---|---|---|
| dg_Design_1 | Normal | Conjunction_4 | Conjunction'_3 (IgG1, IgG4) | Native | Native |
| dg_Design_2 | Normal | Conjunction_5 | Conjunction'_3 (IgG1, IgG4) | Native | Native |
| dg_Design_3 | Cross | Conjunction_6 | Conjunction'_4 (IgG1, IgG4) | Native | Native |
| dg_Design_4 | Cross | Conjunction_7 | Conjunction'_4 (IgG1, IgG4) | Native | Native |

A total of thirteen chimeric constructs were designed by combining these parameters, as listed in Table 31.

TABLE 31

Correspondence of the design of chimeric TCR/antibody for CGamma/CDelta

| Designs in Table 30 of IgG1 | Construct of Design | SEQ ID NOs in HC/LC |
|---|---|---|
| dg_Design_1 | dg_Design_1 | 108/107 |
| dg_Design_2 | dg_Design_2 | 106/105 |
| | dg_Design_2_no_Glyco | 86/85 |
| | dg_Design_2_hypeCys1_no_Glyco | 90/89 |
| | dg_Design_2_hypeCys2_no_Glyco | 92/91 |
| | dg_Design_2_hypeCys3_no_Glyco | 94/93 |
| | dg_Design_2_Cys2_no_Glyco | 96/95 |
| | dg_Design_2_Cys1_no_Glyco | 98/97 |
| | dg_Design_2_Cys3_no_Glyco | 99/95 |
| | dg_Design_2_Cys4_no_Glyco | 101/100 |
| | dg_Design_2_Cys5_no_Glyco | 101/102 |
| dg_Design_3 | dg_crossed_Design_1 | 110/109 |
| dg_Design_4 | dg_crossed_Deisgn_2 | 112/111 |

TABLE 32

Components of the design of chimeric TCR/antibody for CGamma/CDelta

| Complex name and chain SEQ ID NOs: | Antibody Heavy Chain Variable Domain (VH or VL) | First or Second Conjunction domain (CJ) | TCR Constant Domain (C1 or C2) | Third Conjunction domain + Hinge (CJ') | Dimerization Domain (D) |
|---|---|---|---|---|---|
| dg_Design_1 HC SEQ ID NO: 108 | VH(CD3) SEQ ID NO: 300 | HCJ4 SEQ ID NO: 117 | CGamma SEQ ID NO: 113 | CJ'3G1 SEQ ID NO: 121 | FcG1 SEQ ID NO: 302 |
| dg_Design_1 LC SEQ ID NO: 107 | VL(CD3) SEQ ID NO: 301 | LCJ4 SEQ ID NO: 119 | CDelta SEQ ID NO: 310 | | |
| dg_Design_2 HC SEQ ID NO: 106 | VH(CD3) SEQ ID NO: 300 | HCJ5 SEQ ID NO: 118 | CGamma SEQ ID NO: 113 | CJ'3G1 SEQ ID NO: 121 | FcG1 SEQ ID NO: 302 |
| dg_Design_2 LC SEQ ID NO: 105 | VL(CD3) SEQ ID NO: 301 | LCJ5 SEQ ID NO: 120 | CDelta SEQ ID NO: 115 | | |
| dg_Design_2_no_Glyco HC SEQ ID NO: 86 | VH(CD3) SEQ ID NO: 300 | HCJ5 SEQ ID NO: 118 | CGamma (N65Q) SEQ ID NO: 114 | CJ'3G1 SEQ ID NO: 121 | FcG1 SEQ ID NO: 302 |
| dg_Design_2_no_Glyco LC SEQ ID NO: 85 | VL(CD3) SEQ ID NO: 301 | LCJ5 SEQ ID NO: 120 | CDelta(N16Q + N79Q) SEQ ID NO: 116 | | |
| dg_Design_2_hypeCys1_no_Glyco HC SEQ ID NO: 90 | VH(CD3) SEQ ID NO: 300 | HCJ5 SEQ ID NO: 118 | CGamma(T12C) (N65Q) SEQ ID NO: 333 | CJ'3G1 SEQ ID NO: 121 | FcG1 SEQ ID NO: 302 |
| dg_Design_2_hypeCys1_no_Glyco LC SEQ ID NO: 89 | VL(CD3) SEQ ID NO: 301 | LCJ5 SEQ ID NO: 120 | CDelta (N16C) (N79Q) SEQ ID NO: 325 | | |
| dg_Design_2_hypeCys2_no_Glyco HC SEQ ID NO: 92 | VH(CD3) SEQ ID NO: 300 | HCJ5 SEQ ID NO: 118 | CGamma (Q57C) (N65Q) SEQ ID NO: 334 | CJ'3G1 SEQ ID NO: 121 | FcG1 SEQ ID NO: 302 |
| dg_Design_2_hypeCys2_no_Glyco LC SEQ ID NO: 91 | VL(CD3) SEQ ID NO: 301 | LCJ5 SEQ ID NO: 120 | CDelta (V50C) (N16Q + N79Q) SEQ ID NO: 326 | | |
| dg_Design_2_hypeCys3_no_Glyco HC SEQ ID NO: 94 | VH(CD3) SEQ ID NO: 300 | HCJ5 SEQ ID NO: 118 | CGamma (M62C) (N65Q) SEQ ID NO: 335 | CJ'3G1 SEQ ID NO: 121 | FcG1 SEQ ID NO: 302 |
| dg_Design_2_hypeCys3_no_Glyco LC SEQ ID NO: 93 | VL(CD3) SEQ ID NO: 301 | LCJ5 SEQ ID NO: 120 | CDelta (D46C) (N16Q + N79Q) SEQ ID NO: 327 | | |
| dg_Design_2_Cys2_no_Glyco HC SEQ ID NO: 96 | VH(CD3) SEQ ID NO: 300 | HCJ5 SEQ ID NO: 118 | CGamma(S17C) (N65Q) SEQ ID NO: 336 | CJ'3G1 SEQ ID NO: 121 | FcG1 SEQ ID NO: 302 |
| dg_Design_2_Cys2_no_Glyco LC SEQ ID NO: 95 | VL(CD3) SEQ ID NO: 301 | LCJ5 SEQ ID NO: 120 | CDelta (F12C) (N16Q + N79Q) SEQ ID NO: 328 | | |
| dg_Design_2_Cys1_no_Glyco HC SEQ ID NO: 98 | VH(CD3) SEQ ID NO: 300 | HCJ5 SEQ ID NO: 118 | CGamma(F14C) (N65Q) SEQ ID NO: 337 | CJ'3G1 SEQ ID NO: 121 | FcG1 SEQ ID NO: 302 |
| dg_Design_2_Cys1_no_Glyco LC SEQ ID NO: 97 | VL(CD3) SEQ ID NO: 301 | LCJ5 SEQ ID NO: 120 | CDelta(M14C) (N16Q + N79Q) SEQ ID NO: 329 | | |
| dg_Design_2_Cys3_no_Glyco HC SEQ ID NO: 99 | VH(CD3) SEQ ID NO: 300 | HCJ5 SEQ ID NO: 118 | CGamma (E20C) (N65Q) SEQ ID NO: 338 | CJ'3G1 SEQ ID NO: 121 | FcG1 SEQ ID NO: 302 |
| dg_Design_2_Cys3_no_Glyco LC SEQ ID NO: 95 | VL(CD3) SEQ ID NO: 301 | LCJ5 SEQ ID NO: 120 | CDelta (F12C) (N16Q + N79Q) SEQ ID NO: 328 | | |
| dg_Design_2_Cys4_no_Glyco HC SEQ ID NO: 101 | VH(CD3) SEQ ID NO: 300 | HCJ5 SEQ ID NO: 118 | CGamma (A19C) (N65Q) SEQ ID NO: 339 | CJ'3G1 SEQ ID NO: 121 | FcG1 SEQ ID NO: 302 |
| dg_Design_2_Cys4_no_Glyco LC | VL(CD3) | LCJ5 | CDelta(F87C) (N16Q + N79Q) | | |

TABLE 32-continued

Components of the design of chimeric TCR/antibody for CGamma/CDelta

| Complex name and chain SEQ ID NOs: | Antibody Heavy Chain Variable Domain (VH or VL) | First or Second Conjunction domain (CJ) | TCR Constant Domain (C1 or C2) | Third Conjunction domain + Hinge (CJ') | Dimerization Domain (D) |
|---|---|---|---|---|---|
| SEQ ID NO: 100 dg_Design_2_Cys5_no_Glyco HC | SEQ ID NO: 301 VH(CD3) | SEQ ID NO: 120 HCJ5 | SEQ ID NO: 330 CGamma (A19C) (N65Q) | CJ'3G1 | FcG1 |
| SEQ ID NO: 101 dg_Design_2_Cys5_no_Glyco LC | SEQ ID NO: 300 | SEQ ID NO: 118 LCJ5 | SEQ ID NO: 339 CDelta (E88C) (N16Q + N79Q) | SEQ ID NO: 121 | SEQ ID NO: 302 |
| SEQ ID NO: 102 dg_crossed_Design_1 HC | VH(CD3) | SEQ ID NO: 120 HCJ6 | SEQ ID NO: 331 CDelta | CJ'4G1 | FcG1 |
| SEQ ID NO: 110 dg_crossed_Design_1 LC | SEQ ID NO: 300 VL(CD3) | SEQ ID NO: 123 LCJ6 | SEQ ID NO: 332 CGamma | SEQ ID NO: 127 | SEQ ID NO: 302 |
| SEQ ID NO: 109 dg_crossed_Design_2 HC | SEQ ID NO: 301 VH(CD3) | SEQ ID NO: 125 HCJ7 | SEQ ID NO: 340 CDelta | CJ'4G1 | FcG1 |
| SEQ ID NO: 112 dg_crossed_Design_2 LC | SEQ ID NO: 300 VL(CD3) | SEQ ID NO: 124 LCJ7 | SEQ ID NO: 332 CGamma | SEQ ID NO: 127 | SEQ ID NO: 302 |
| SEQ ID NO: 111 | SEQ ID NO: 301 | SEQ ID NO: 126 | SEQ ID NO: 340 | | |

Example 6: Antibody Heavy-Light Chain Mispairing Tests

One of the challenges in producing bispecific antibody in IgG-like format is the uncontrolled mispairing of light and heavy chains. We evaluated whether the TCR beta and alpha-replaced CH1 and CL domain can assemble with normal IgG heavy chain and light chain when they were co-expressed in a single host cell.

Figures 6A, 6B:
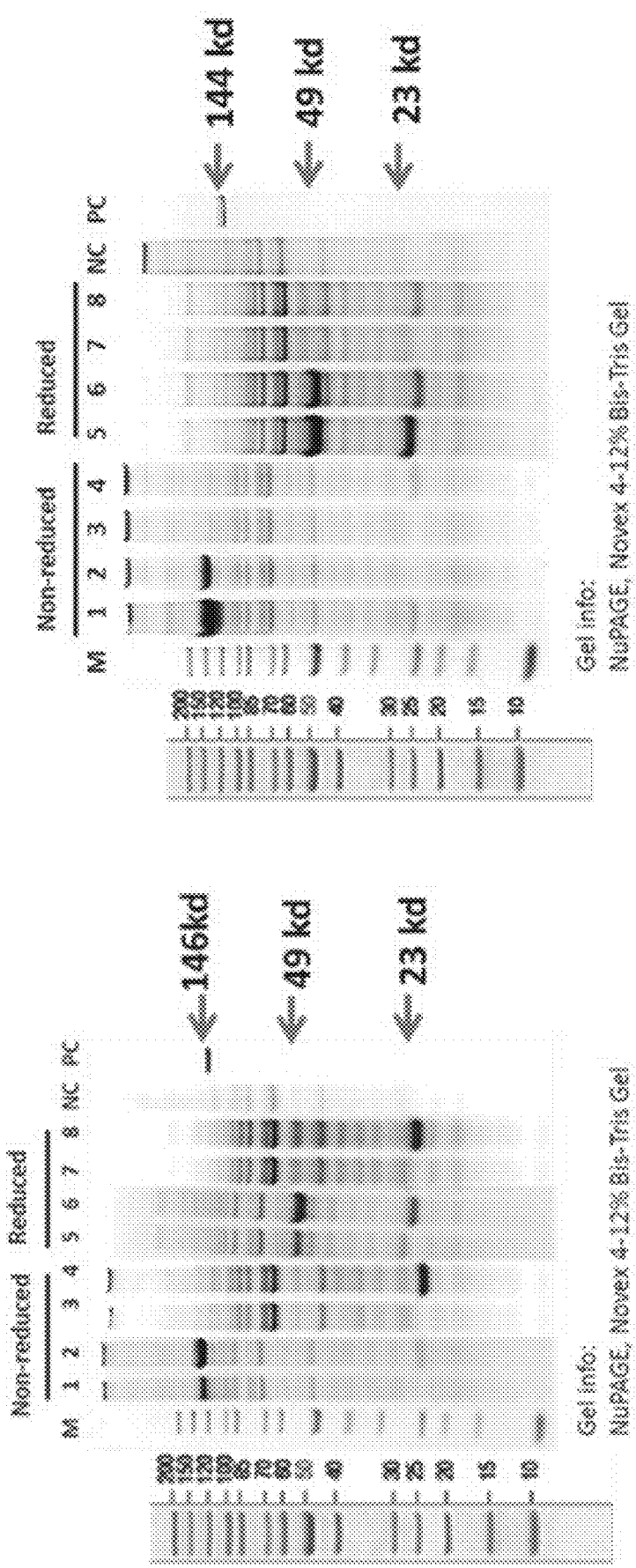
FIGS. 6A-6B show SDS-PAGE results of the chain mis-pairing tests of antibody T3 and U4 in IgG1 (FIG. 6A) and IgG4 (FIG. 6B) isotype. Lanes 1-2 are the pairs of T3 light-U4_heavy and T3_heavy-U4_light, respectively. Lanes 3-4 are the same pair order as lanes 1-2, but with the modified T3 using TCR constant region. Lanes 1-4 in both pictures are the non-reduced samples, and Lanes 5-8 are the corresponding reduced samples.

Besides the anti-CD3 antibody T3, we also developed a monoclonal antibody U4 that targets B-lymphocyte antigen CD19. In order to check how likely the light chains and heavy chains of two native antibodies can be mispaired, the light-heavy pairs of T3 and U4 were switched on purpose (T3_light-U4_heavy, T3_heavy-U4_light), and co-expressed in Expi293 cells. The same study using the TCR-modified T3 was also conducted as side-by-side comparison. FIGS. 6A-6B displayed SDS-PAGE data of the proteins in both IgG1 and IgG4. For the switched pairs using native antibodies, the 150 kd band in non-reduced page, and the 50 kd, 23 kd bands in reduced page, clearly confirmed the assembly of mispaired IgG protein. However, after introducing the TCR-modified T3, the 150 kd bands were not observed from the gel any more, indicating neither of the non-cognate pairs can assemble into antibody-like molecule. These data confirmed that our designed TCR-modified Fab can effectively prevent mispairing non-cognitive chains.

Example 7: Production and Characterization of Fab-TCR Chimera

Figure 8:
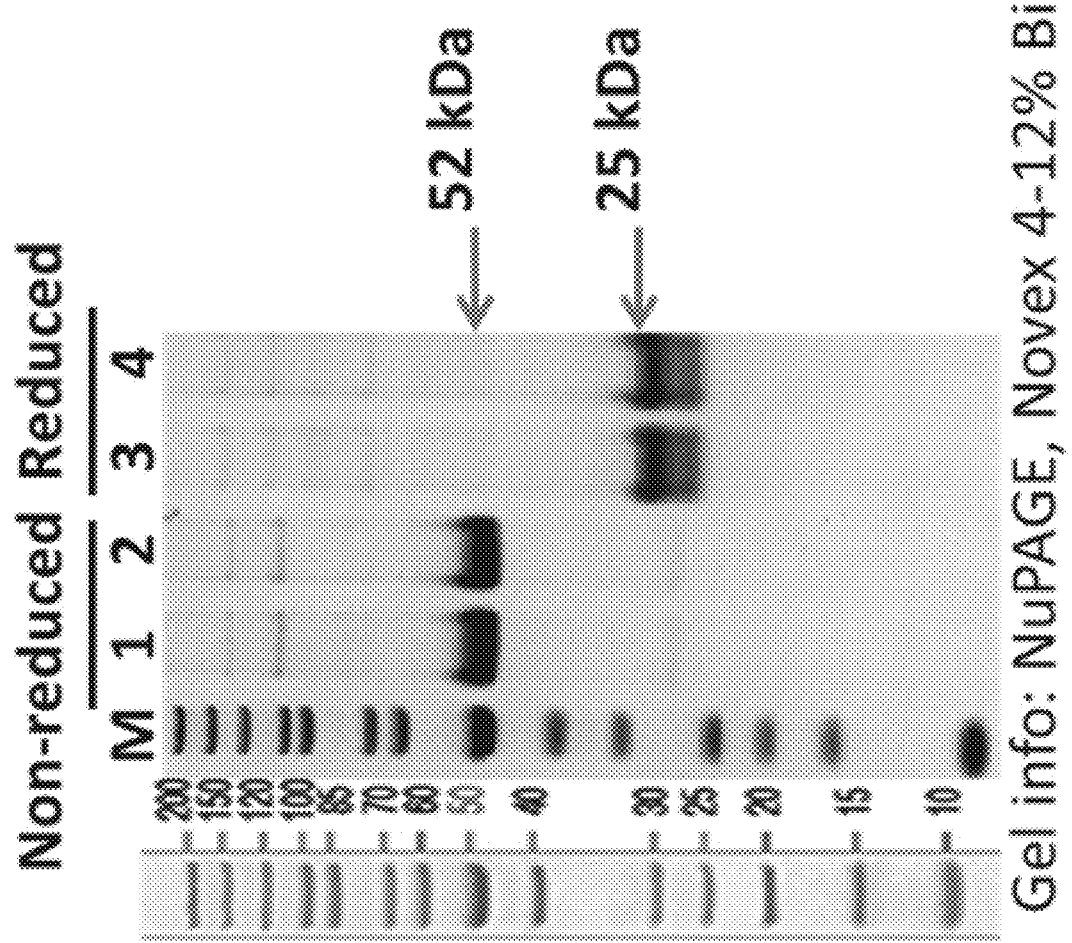
FIG. 8 shows SDS-PAGE results of Fab fragments of chimeric T3 with a 6×His-tag, purified by Ni Sepharose™ excel chromatography. Lanes 1 and 3 are bands for T3-Fab-Design_2.his1, and Lanes 2 and 4 are bands for T3-Fab-Design_2.his2.
Figure 9:
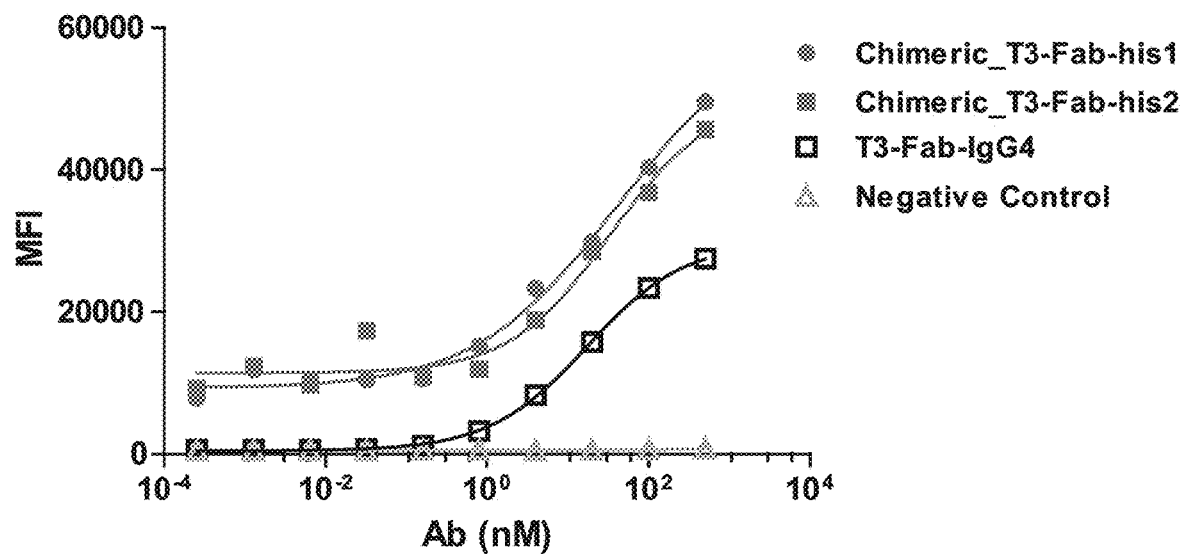
FIG. 9 illustrates dose-dependent FACS bindings of the Fab fragment of the TCR-modified chimeric T3. The monovalent form of wild type T3 antibody (T3-Fab-IgG4) was used as a positive control. A regular human IgG4 antibody was used as a negative control.

To make sure that TCR-modified antibody Fab can be used to design bispecific antibody, Fab fragments truncated at two positions were constructed. FIG. 8 shows that the TCR-modified T3 Fabs with N-glycan removed were successfully expressed and purified (T3-Fab-Design_2.his1 (SEQ ID NO: 30/12) and T3-Fab-Design_2.his2 (SEQ ID NO: 31/12)). Their binding capability to CD3 were also evaluated on CD3+ Jurkat cells, and compared to the monovalent form of wild type T3. FIG. 9 showed that the chimeric Fab and monovalent T3 had qualitatively similar binding behaviors. The deviations might result from the difference in detection methods for proteins with His and Fc tag.

Example 8: Generation and Characterization of TCR-Based Knobs-into-Holes Bispecific Antibody After successfully fusing the TCR constant domain into the monospecific antibody T3, and confirming that the new format can effectively prevent chain mispairing with antibody U4, we proceeded to construct bispecific formats.

Figures 7A, 7B:
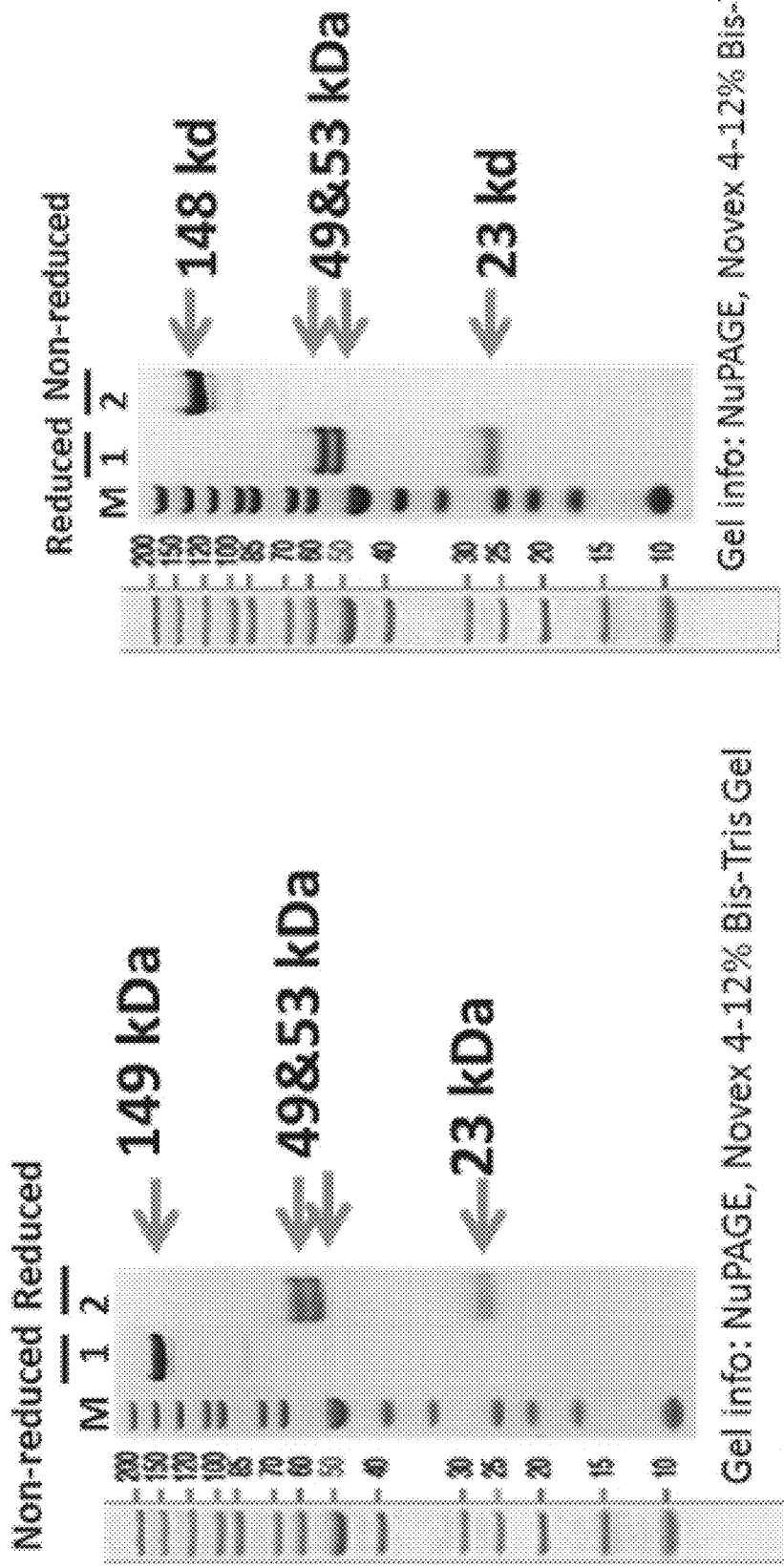
FIGS. 7A-7B show SDS-PAGE results of purified bispecific antibody, E17-Design_2-QQQQ in (FIG. 7A) IgG1 and (FIG. 7B) IgG4. The IgG1 isotype was purified by three step purifications: protein A chromatography, Ion-Exchange Chromatography (IEC) and Size Exclusion Chromatography (SEC). The IgG4 was obtained after two-step purifications: protein A chromatography and SEC.
Figure 7C:
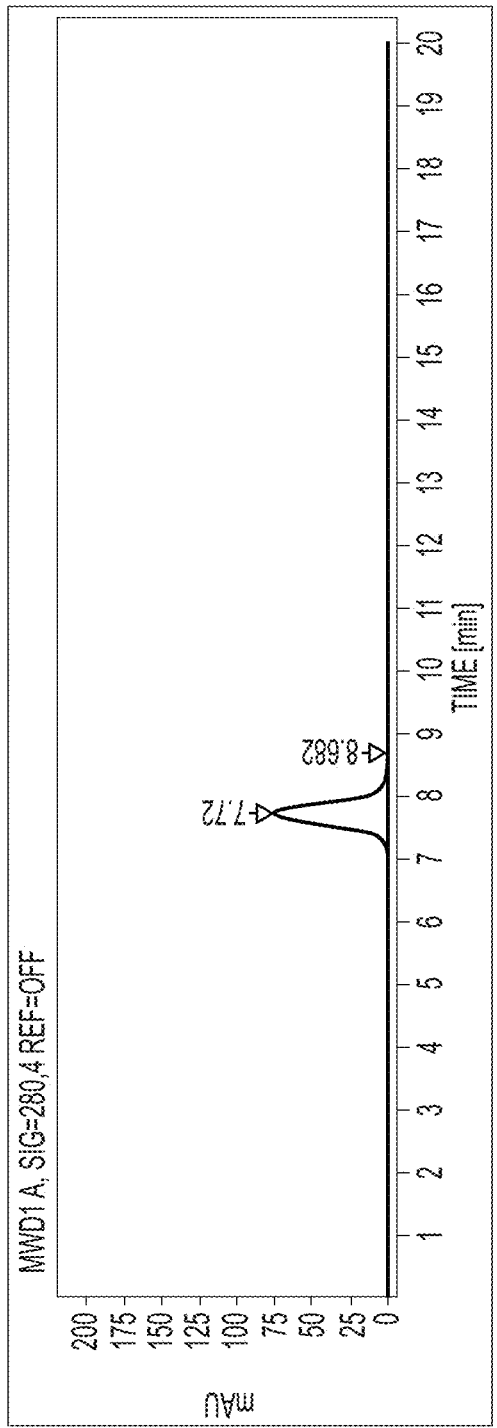
FIGS. 7C-7D show SEC-HPLC data for the purified samples of IgG1 (FIG. 7C) and IgG4 (FIG. 7D) to determine the purities of the samples.
Figure 7D:
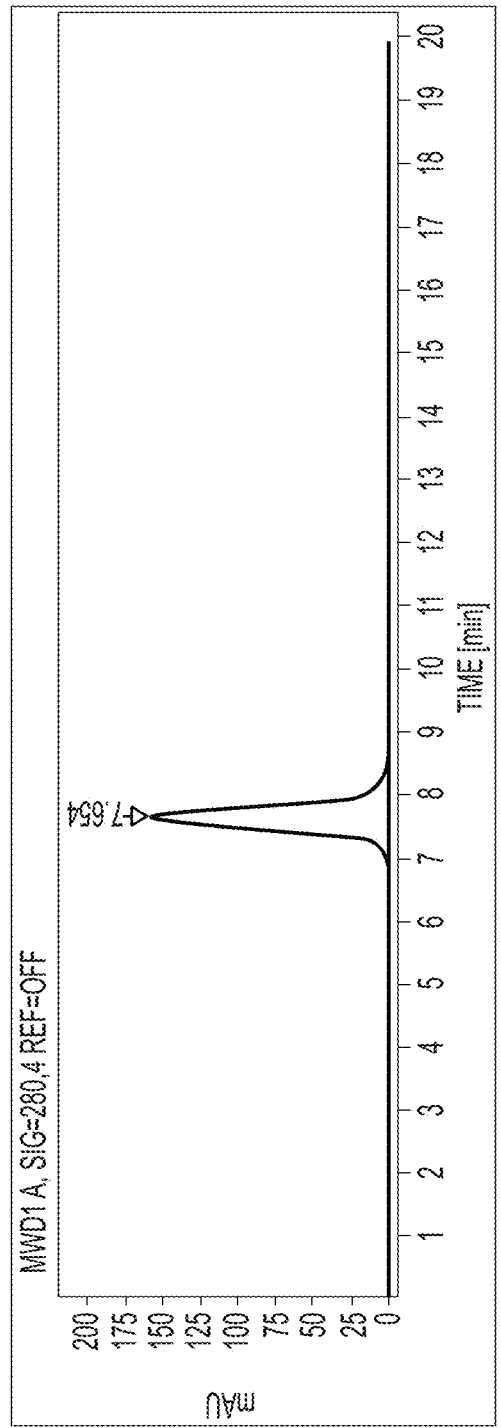

TCR-modified T3 and wild type U4, with "knobs-into-holes" mutations employed in Fc CH3 domain, were co-expressed from Expi293 cells. The mutations for "knobs-into-holes" were made at S139C and T151W in the CH3 domain (SEQ ID NO: 295, knob) of T3 and Y134C, T151S, L153A and Y192V in the CH3 domain (SEQ ID NO: 296, hole) of U4 in the IgG1 isotype. Alternatively, the knobs-into-holes mutations were made at S136C and T148W in the CH3 domain (SEQ ID NO: 298, knob) of T3 and Y131C, T148S, L150A and Y189V in the CH3 domain (SEQ ID NO: 299, hole) of U4 in the IgG4 isotype. FIGS. 7A-7B show the SDS-PAGE data of the produced proteins in IgG1 and IgG4 after purifications. The yield after first-step protein A purification achieved 125 mg/L and 173.7 mg/L, for IgG1 and IgG4 respectively. The correct molecular weight, i.e. the bands around 150 kd in non-reduced gel as well as the bands around 50 and 25 kd in reduced gel, were all clearly observed. The purified samples were further inspected in SEC-HPLC. The purity of IgG1 and IgG4 achieved 98.63% and 100%. The data indicated that the IgG-like molecules, both IgG1 and IgG4 were well expressed and assembled. These TCR-involved new bispecific formats were referred as 'E17-Design_2-QQQQ' (SEQ ID NO: 22/12/24/23 for IgG1 and SEQ ID NO: 25/12/26/23 for IgG4).

Figure 10A:
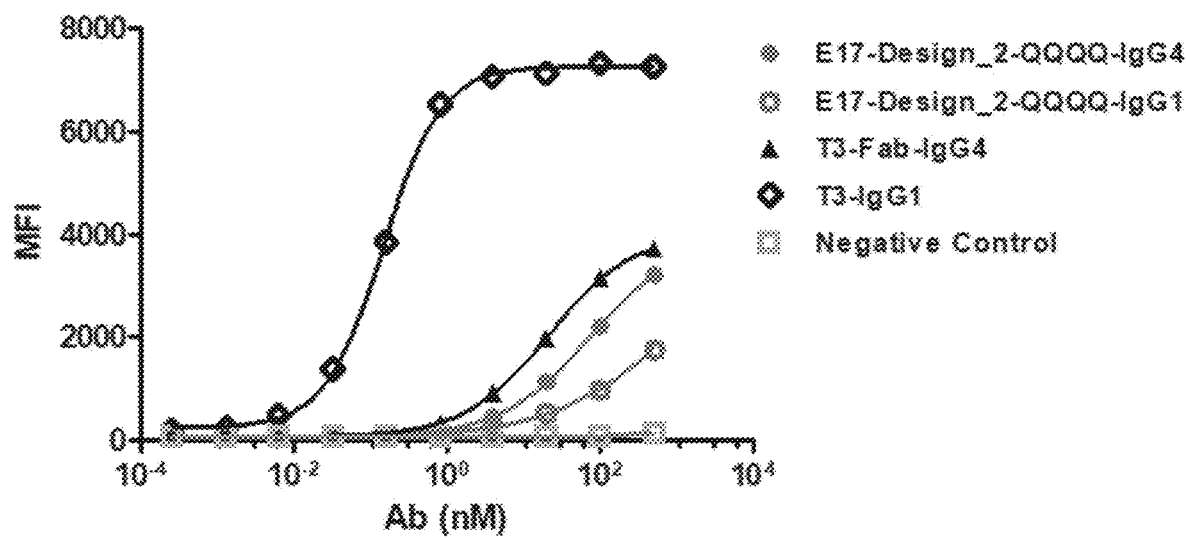
FIGS. 10A-10B show dose-dependent FACS bindings of the designed bispecific antibody, E17-Design_2-QQQQ, to CD3+ Jurkat cells. The wild type antibody T3 and U4, as well as their monovalent forms, were used as positive controls (FIG. 10A) and CD19+ Ramos cells (FIG. 10B). Both IgG1 and IgG4 isotypes were tested. A irrelevant human IgG1 or IgG4 antibody was used as a negative control.
Figure 10B:
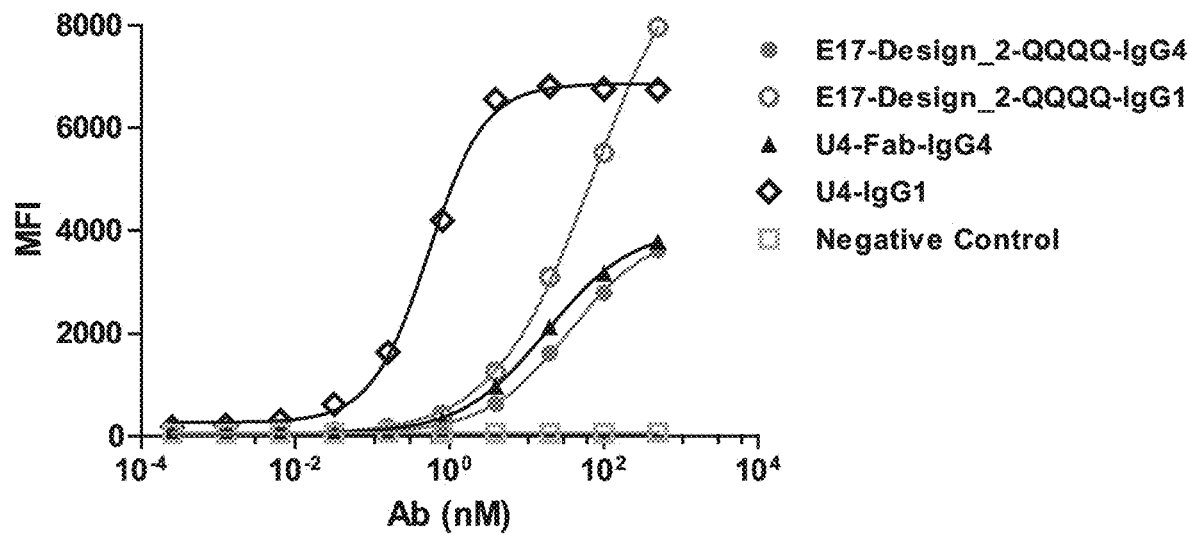

Although the expected molecular weight was observed for the designed bispecific antibody, it was necessary to inspect whether each arm maintained their original binding capability to their individual cognate antigen. Since for each target, E17-Design_2 was monovalent binder, we also constructed the monovalent version of native T3 and native U4 to make the side-by-side comparisons. FIG. 10A and FIG. 10B show the FACS binding results of the designed bispecific antibody to CD3+ Jurkat cells and CD19+ Ramos cells, respectively. The arm of the TCR-modified T3 exhibited moderate binding loss compared to the wild type T3, but IgG4 was better than IgG1 and close to the native protein. The binding of the U4 arm was not reduced by the neighboring engineered T3 arm. It had binding similar to the original U4 antibody in monovalent form. But interestingly, this time IgG1 performed better than IgG4. It is unclear why isotype matters in maintaining the monovalent binding. Factors like stability of TCR constant region, selection of the third conjunction domain designs, or interactions between two Fab arms could result in observed phenomena.

The monovalent bindings of the TCR-modified bispecific format to CD3 and CD19 were both reduced compared with their bivalent parental antibodies. It is known that T cell activation via CD3 binding is quite sensitive. Strong stimulations to T cells may cause side effects. Therefore, the relatively weak CD3-binding was probably acceptable and even desired for safety reason. However, the weak CD19-binding might directly affect its capability in bispecific antibody directed B cell killing, and thus reduce the drug efficacy. To confirm the importance of CD19 binding, and to test the universality of our chimeric designs, we built another bispecific constructs named as "F16-Design_2-QQQQ" in IgG4, in which the designed T3 arm was still monovalent, but the U4 arm was bivalent.

Figure 11A:
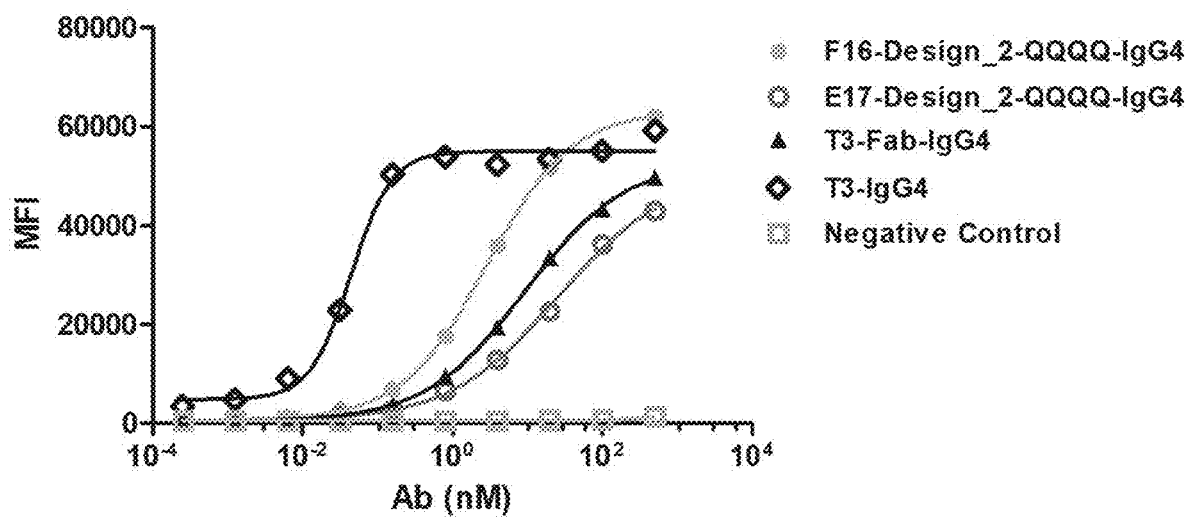
FIGS. 11A-11B show comparison of the FACS bindings of two designed bispecific antibodies, E17-Design_2-QQQQ and F16-Design_2-QQQQ, to CD3 on Jurkat cells (FIG. 11A) and CD19 expressed on Ramos cells (FIG. 11B). The bispecific antibodies in both IgG1 and IgG4 isotypes were tested. A regular human IgG1 or IgG4 antibody was used as a negative control.
Figure 11B:
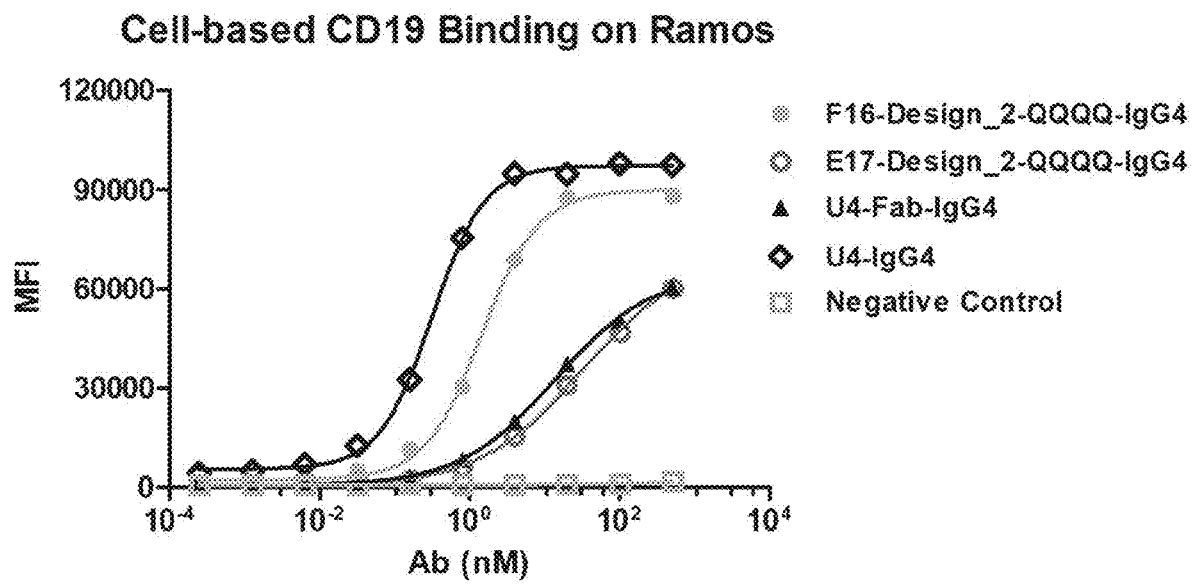

The new construct was expressed and purified, and the binding experiment was directly carried out. FIGS. 11A-11B showed its FACS binding data compared to previously designed E17 and two parental antibodies T3 and U4. It is interesting that the F16-Design_2-QQQQ improved both CD3- and CD19-binding (SEQ ID NO: 25/12/27/23 in the order HC/LC (anti-CD3)/HC/LC (anti-CD19)). Its CD19-binding (SEQ ID NO: 27/23) was comparable to the wild type antibody U4. The data confirmed that our chimeric design on T3 can be applied to different bispecific formats.

Figure 12:
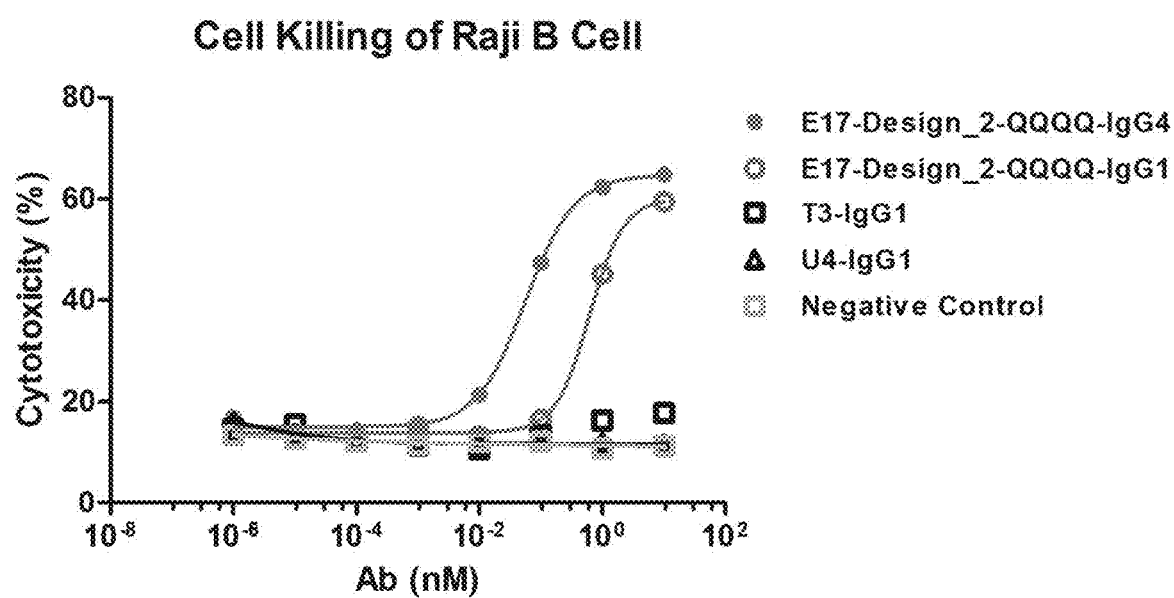
FIG. 12 illustrates the cytotoxic assay of T-cell directed killing malignant B cell, mediated by the designed bispecific antibodies E17-Design_2-QQQQ in both IgG1 and IgG4. The parental monospecific anti-CD3 (T3-IgG4), anti-CD19 (U4-IgG) antibody and an irrelevant human IgG1 antibody was used as the negative control.
Figure 13:
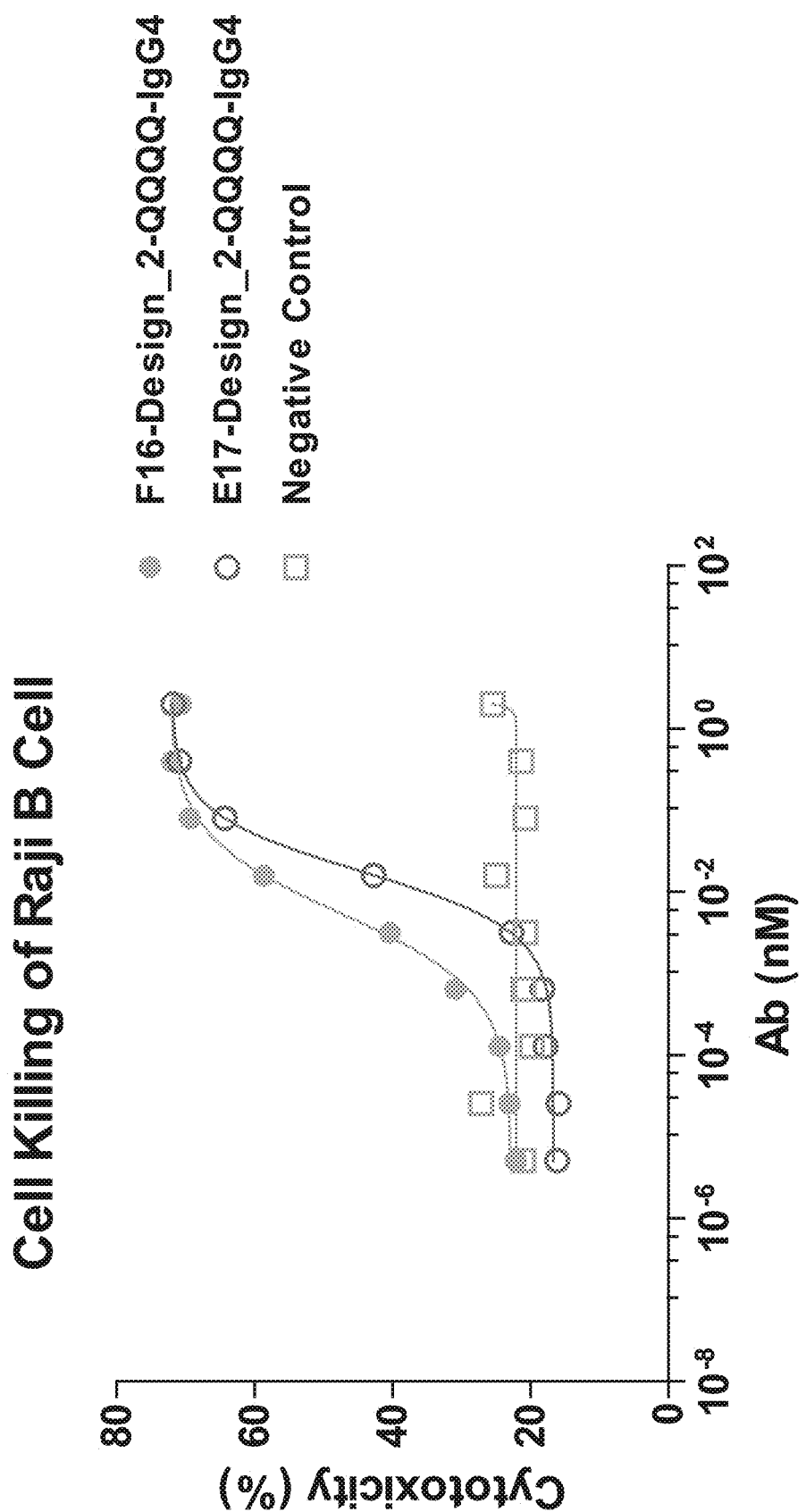
FIG. 13 compares the activity of two designed bispecific antibody, E17-Design_2-QQQQ and F16-Design_2-QQQQ in mediating T-cell engaged malignant B cell killing. An irrelevant human IgG antibody was used as the negative control.

Example 9: In Vitro Assay of Bispecific Antibody-Directed Tumor Cell Killing In vitro functional assay was performed to check activity of the designed bispecific format in T cell engaged killing of malignant B cells. E17 construct was tested first. The parental monospecific antibodies T3 and U4 were used as negative controls. FIG. 12 shows the dose-dependent cell killing function of this E17 bispecific format. E17-IgG4 (EC50=57 pM) was more potent than E17-IgG1 (EC50=624 pM). In order to improve the activity of cell killing, F16 format, which had two CD19-binding sites, was also compared with E17. As shown in FIG. 13, compared with E17 (EC50=17.7 pM), the potency of F16 (EC50=5.5 pM) was 3 times improved. The data confirmed the binding of CD19 affected the cell killing effect. An irrelevant human IgG4 antibody was used as negative control.

Example 10: Mass Spectrometry Characterization

Figure 14A:
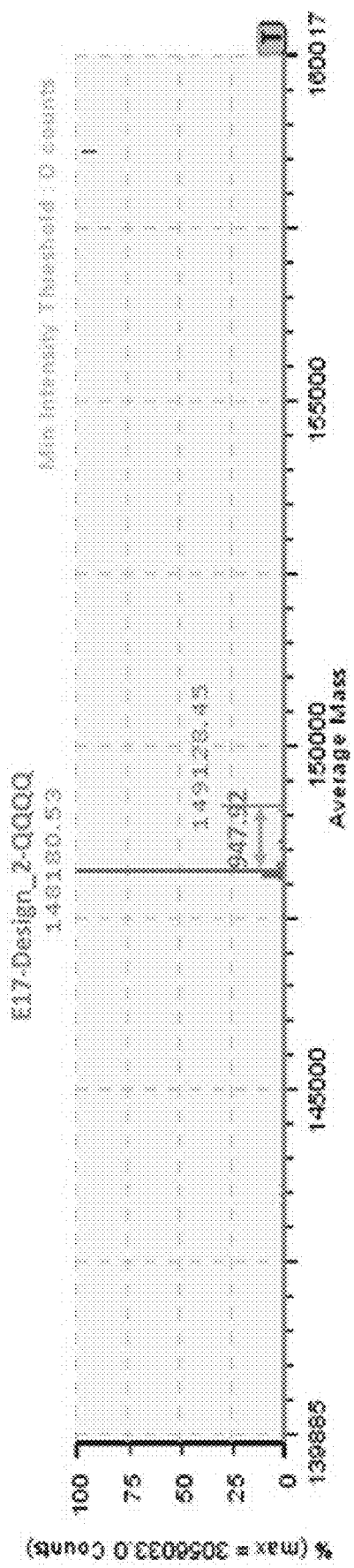
FIGS. 14A-14B show deconvoluted mass spectra of bispecific antibody E17-Design_2-QQQQ in non-reduced (FIG. 14A) and reduced (FIG. 14B) conditions. Peak at 148180.53 in FIG. 14A is the correct molecular weight of the intact WuXiBody. The peak with 22877 Da indicates the light chain found in the reduced mass spectra in FIG. 14B. The small peak at 149128.45 Da in FIG. 14A was deduced to be the O-glycosylation (approximately (947.92 Da more) located on the light chain, as showed in FIG. 14B.

To confirm that the produced bispecific antibody had the correct assembly, we characterized the molecule E17-Design_2-QQQQ in mass spectrometry. The differences of theoretical molecular weight between two heavy chains and two light chains are around 4000 Da and 500 Da, respectively. FIG. 14A showed the spectra of the protein in non-reduced condition. The peak at 148180 Da was the expected molecule weight of the correctly assembled bispecific antibody. No observed other peak indicates that the "knobs-into-holes" mutations in Fc region as well as our TCR-replaced CH1/CL region worked properly in pairing the desired four chains. It is noteworthy that the non-reduced mass spectra cannot help distinguish the correct assembled bispecific antibody from the IgG that has both light chains mispaired. However, Example 4 indicates that mis-paired heavy and light chains would not express or assemble, which eliminated the possibility of mis-pairing of both pairs of heavy and light chains.

Figure 14B:
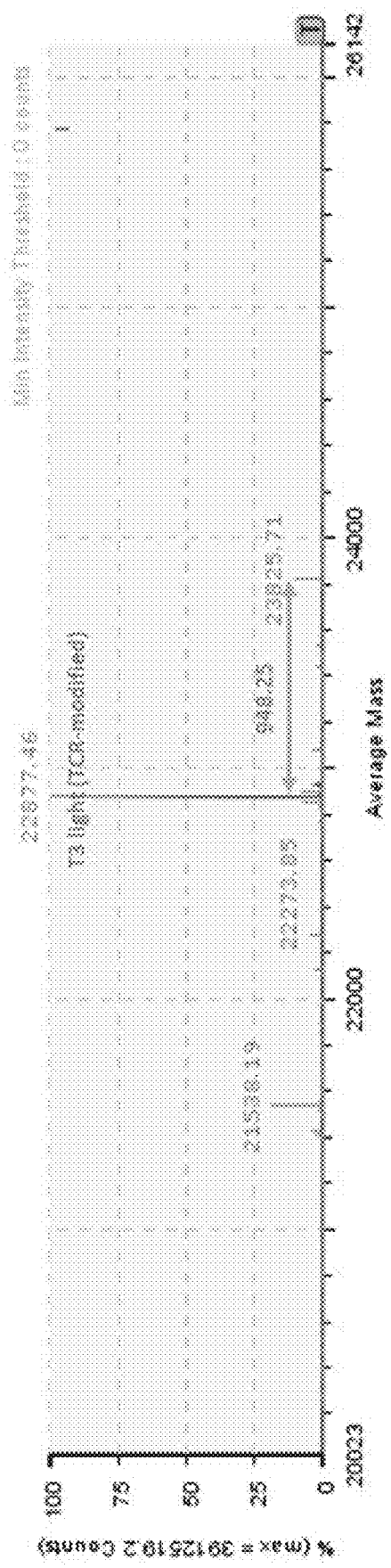

In non-reduced condition (see FIG. 14A), there was a peak at 149128 Da, which is around 947 Da more than calculated molecule weight. A mass spectrometry analysis was also conducted using the protein in reduced condition. FIG. 14B showed that there was indeed a peak 948 Da away from the VL-CAlpha chimeric light chain, indicating O-glycan modifications (GlcNAc+Hex+2*NeuAc) on the light chain.

Example 11: Thermal Stability Tests

We further tested and compared the thermal stability of the designed bispecific antibodies in both IgG1 and IgG4 via measuring the protein melting temperature $T_m$ using Differential Scanning Fluorimetry (DSF). The native monospecific T3 and the TCR-modified T3 (Design_2 and Design_2-QQQQ) were served as controls.

Table 33 listed measured $T_{on}$, $T_m$ values of the new constructs. Overall, all molecules displayed reasonable thermal stability. IgG1-like molecules were more stable than IgG4-like molecules. The $T_m$ value of the native T3 antibody was 74° C. The TCR antibody chimeric proteins had a relatively lower $T_m$ of around 60° C., suggesting that TCR CBeta-CAlpha might be less resistant to the elevated temperatures compared to the CH1-CL of normal antibody. This is consistent to what reported from Wu's study (Wu et al. 2015, supra), and the CAlpha domain was suggested to be less stable than CBeta (Toughiri et al. *mAbs*, 862(July), pp. 1276-1285(2016)).

Mutations removing N-glycosylation on TCR constant region did not affect the thermal stability of the chimeric protein. Our bispecific antibody E17-Design_2-QQQQ had similar $T_m$ to that of Design_2-QQQQ, and lower $T_m$ than the native T3.

TABLE 33

Thermostability of designed chimeric and bispecific antibody measured by Differential Scanning Fluorimetry (DSF)

| Protein Name HC/LC(anti-CD3)/HC/LC(anti-CD19) | Isotype | Concentration (mg/ml) | $T_{on}$ (° C.) | $T_h 1$ ($T_m$) (° C.) | $T_h 2$ (° C.) | pI | Purity |
|---|---|---|---|---|---|---|---|
| T3 | IgG1 | 2.7 | 57 | 74.2 | na | 8.31 | 99.41% |
| Design_2 ( SEQ ID NO: 4/3/4/3) | IgG1 | 1.6 | 46 | 59.3 | na | 6.07 | 93.09% |

TABLE 33-continued

Thermostability of designed chimeric and bispecific antibody measured by Differential Scanning Fluorimetry (DSF)

| Protein Name HC/LC(anti-CD3)/HC/LC(anti-CD19) | Isotype | Concentration (mg/ml) | $T_{on}$ (°C.) | $T_h1$ ($T_m$) (°C.) | $T_h2$ (°C.) | pI | Purity |
|---|---|---|---|---|---|---|---|
| Design_2-QQQQ (SEQ ID NO: 13/12/13/12) | IgG1 | 1.1 | 45 | 59.1 | na | 6.07 | 99.03% |
| E17-Design_2-QQQQ (SEQ ID NO: 22/12/24/23) | IgG1 | 0.3 | 49 | 61.9 | 76.2 | 7.29 | 98.63% |
| T3 | IgG4 | 1.4 | 53 | 65 | 73.2 | 8.24 | 96.06% |
| Design 2-QQQQ (SEQ ID NO: 21/12/21/12) | IgG4 | 0.9 | 45 | 58.4 | na | 5.7 | 96.05% |
| E17-Design_2-QQQQ (SEQ ID NO: 25/12/26/23) | IgG4 | 0.8 | 47 | 60.2 | 72.7 | 6.4 | 100% |

Example 12: Materials and Methods

Antibody T3 Fv Homology Modeling

Antibody Fv structural model was built based on its Fv amino acid sequences using software Discovery Studio (BIOVIA). Both light and heavy chain sequences were firstly annotated in Kabat numbering to identify three CDRs as well as the framework of each chain. Each segment (either CDR or framework) was then BLAST-searched in the antibody database with sequences from all antibody structures in PDB. The structure of the most matched sequence, if having high resolution and low B factor, were used to build the homology model. All modeled segments were then assembled to construct the light and heavy chain structural model. The relative orientation between two modeled chains was predicted by taking the angle of the antibody structure that had the most similar overall sequence. All molecular visualization and analysis work was conducted using PyMOL software (Schrödinger).

Vector Constructions

The VL, VH, Ck, CH1 genes were amplified by PCR from existing in-house DNA templates. CAlpha and CBeta genes were synthesized by Genewiz Inc. Native or chimeric light chain genes were inserted into a linearized vector containing a CMV promoter and a kappa signal peptide. The DNA fragments of VH-CH1 or VH-CBeta were inserted into a linearized vector containing human IgG4/IgG1 constant region CH2-CH3. The vector contains a CMV promoter and a human antibody heavy chain signal peptide. Plasmid ligations, transformations, DNA preparations were performed using standard molecular biology protocols. The site-directed mutagenesis was conducted by PCR amplification using mutagenic primers and followed by DpnI digestion of template DNA.

Protein Expression

The constructed vectors of heavy chain and light chain were co-transfected into Expi293 cells (Thermofisher Scientific). The ratio of different vectors for co-transfection was adjusted according to the expected structure of the antibodies and the initial expression result shown on SDS-PAGE. Briefly, 40 μg plasmid and 108 μl of expifectamine were used to transfect 40 ml volume of $1.2 \times 10^8$ cells. Enhancer 1 and Enhancer 2 were added 20 hours after transfection. The transfected cells were cultured at 37° C. with 8% $CO_2$ on an orbital shaker, rotating at 120 rpm. Five days after transfection, the supernatants were harvested by centrifuge and cell fragments were removed by 0.22 m filtering.

Expression Detection by SDS-PAGE

Supernatant harvested on the 5th day was mixed with NuPAGE LDS Sample Buffer (4×), NuPAGE Sample Reducing Agent (10×) and $H_2O$. The reduced samples were heated at 75° C. before loading on the gel. The gels were run using constant 200V for 35 minutes. Then the gels were stained with SimplyBlue™ SafeStain (Invitrogen, LC6065), and microwaved for 5 minutes. Distaining was conducted by incubating with water and microwaved for 7 minutes. The images of the gels were taken using Universal HoodIII (Bio-Rad).

Purification

Protein A Chromatography Purification

MabSelect™ SuRe™ (MSS) Protein A resins were acquired from GE Healthcare and packed into glass columns (BioRad). Purification by Protein A chromatography was performed at room temperature using peristaltic pump as power at a flow rate of 0.2 ml/min. After samples were loaded, 10 column volume of 100 mM Glycine, pH3.5 was used for elution, and different fractions were collected. The protein concentration in different fractions was measured using a NanoDrop™ 2000 (Thermo Fisher Scientific). The protein purity was detected by SDS-PAGE and SEC-HPLC.

Ion-Exchange Chromatography (IEC)

The IEC chromatographic experiments were performed using a Hi trap SP HP 1 ml column from GE Healthcare life sciences with an ÄKTA Pure system (GE Healthcare). The programmed method settings were: wash the column 10 CV with wash buffer A (10 mM $NaH_2PO_4$, pH 6.0); apply the sample using sample inlet; equilibrate the column 10 CV with wash buffer A (10 mM $NaH_2PO_4$, pH 6.0); elute column with wash buffer A and wash buffer B (10 mM $NaH_2PO_4$, 1 M NaCl, pH 6.0). A gradient elution condition was applied as liner step for 50 CV with 30% wash buffer B, liner step for 5 CV with 100% wash buffer B and a step with fill for 10 CV with 100% wash buffer B. The fractions was collected as 0.5 ml per tube according to the UV absorbance value (collection threshold was set as 5 mAU).

Size Exclusion Chromatography (SEC)

The chromatographic experiments were performed using a Superdex™ 200 increase 10/300 GL column and an ÄKTA system from GE Healthcare life sciences. The experiment was run using PBS (137 mM NaCl, 2.68 mM KCl, 1.76 mM $KH_2PO_4$, 10 Mm Na2HPO4, pH 7.0) at 0.5 ml/min. The fractions were collected using automated collection program (collect value was set as 5 mAU of UV absorbance) with 0.5 ml of each fractions.

Ni Sepharose™ Excel Chromatography Purification

Purification of 6×His-tagged protein using Ni Sepharose™ Excel Chromatography Ni Sepharose™ excel resins were purchased from GE Healthcare. The resin was packed into glass columns (BioRad). After the column was washed with 10 column volume (CV) ddH$_2$O to removal the resin storage buffer, it was used for purification of 6×His tagged proteins. Briefly, purification by Ni column was performed at room temperature using peristaltic pump at a flow rate of 0.2 ml/min. After sample loading, 10 CV PBS (50 mM phosphate, 150 mM NaCl, pH 7.0) was used for wash, followed by 5 CV elution buffer1 (50 mM phosphate, 150 mM NaCl, 20 mM imidazole, pH 7.0) to remove weakly bound protein. 10 CV elution buffer2 (50 mM phosphate, 150 mM NaCl, 500 mM imidazole, pH 7.0) was used to elute bound protein. After elution, collected protein was measured using a NanoDrop™ 2000 (Thermo Fisher Scientific). The purity of eluted protein was detected by SDS-PAGE and SEC-HPLC. The column was regenerated using 10 CV ddH$_2$O, 10 CV stripping buffer (50 mM Tris, 500 mM NaCl, 50 mM EDTA, pH 7.4) for sanitation, 10 CV 6 M Guanidine hydrochloride, pH 7.4 and 10 CV 0.1 M Nickel sulfate. The regenerated column was filled with 20% ethanol and stored in 4° C.

Size Exclusion-High Performance Liquid Chromatography (SEC-HPLC)

Purity of the samples was analyzed using a TSK-GEL G3000SWXL column (7.8 mm×300 mm) from Tosoh Bioscience and an Agilent 1200 HPLC system (Agilent Technologies). The column was equilibrated at a flow rate of 1.0 ml/min with phosphate buffer (50 mM sodium phosphate, 150 mM NaCl, pH 7.0). After protein sample of 50 µl was filtered and injected, UV absorbance at 280 nm was monitored. The purity was estimated by integrating the chromatograms.

Measurement of Antibody Concentration by ELISA

ELISA plates were coated with 200 ng/ml (Fab)$_2$ form of goat anti-human IgG-Fc in coating buffer (200 mM Na$_2$CO$_3$/NaHCO$_3$, pH 9.2). After incubation over night at 4° C., the plates were washed once with PBS buffer using a deep well washer machine (Biotek ELx405). Then the plates were blocked with 2% BSA in PBS buffer and incubated at room temperature for 1 hour. The plates were washed 3 times with washing buffer, and the positive control antibody and the diluted samples were added. After 2-hour incubation, the plates were washed 6 times with 300 µl washing buffer, and biotinylated goat anti-human Ig-Fc (Bethyl, 100 µl/well, 1:5000 dilution in 2% BSA) was added as detection antibody. After incubation and wash steps, SA-HRP (Invitrogen, 1:8000 dilution in 2% BSA) was added. Then the plates were incubated at room temperature for another 1 hour. The plates were washed 6 times with 300 µl/well washing buffer. Substrate TMB was added and developed for 10 minutes. Stop solution (2 M HCl, 100 µl/well) was added to stop further color developing and the absorbance was read at 450 nm using a plate reader (Molecular Device SpectraMax®M5e).

Target-Binding Assays

The binding ability of designed molecules was evaluated using CD3+ Jurkat and CD19+ Ramos cell lines, respectively. Both cell lines were obtained from American Type Culture Collection (ATCC), and were maintained in RPMI 1640 medium (Invitrogen, Cat. No. 22400105), supplemented with 10% fetal bovine serum (FBS, Corning, Cat. No. 35-076-CV).

Aliquots of $10^5$ cells per well were collected and washed with 1% bovine serum albumin (BSA, BovoGen-BSAS), followed by the incubation with serial-diluted studied antibodies in 96-well round-bottom plate (Corning, Cat. No. 3799) at 4° C. for 1 hour. After being washed twice with 1% BSA, the plates were further incubated with PE-conjugated goat anti-human IgG Fc antibodies (Jackson Immuno Research Laboratories, Cat. No 109-115-098) at 4° C. for 30 minutes. After the plates were washed twice again, the cells were analyzed by flow cytometry using a FACSCanto II cytometer (BD Biosciences) and associated fluorescence intensity was quantified using the FlowJo software. Four-parameter non-linear regression analysis was used to obtain EC50 values in Prism software (GraphPad Software, Inc).

Bispecific Antibodies-Directed Tumor Cell Killing

In order to obtain human T cells, peripheral blood mononuclear cells (PBMCs) from healthy donors were freshly isolated by Ficoll-Paque PLUS (GE Healthcare-17-1440-03) density centrifugation from heparinized venous blood. After being cultured in RPMI 1640 medium supplemented with 10% FBS, 1% Penicillin/Streptomycin Solution (ScienCell, Cat. No.: 0503), 50 units per mL of human IL-2 ligand protein and 10 ng/mL OKT3 antibody (EBioscience, Cat. No.: 16-0037-85) for 6 days, the PBMCs were passed through EasySep (Stemcell, Cat. No.: 19053) columns for the enrichment of CD8+ T cells. The CD8+ T cells from the negative selection columns were used as effector cells.

In the cytotoxicity assay, CD19+ Raji cells as target cells were pre-labeled with 20 nM CellTrace Far Red (Invitrogen, Cat. No. C34564) at 37° C. for 30 minutes. The cell pellets were then washed twice with phenol-free RPMI 1640 medium (Invitrogen, Cat. No. 11835030) supplemented with 10% FBS. In 96-well round-bottom plate (Corning, Cat. No. 3799), Far Red-stained Raji B cells (20,000 cells/well) were incubated with isolated CD8+ T cells (target: effector cell ratio 1:5) and serial-diluted bispecific antibodies at 37° C. for 4 hours. After incubation, 3 µM propidium iodide (PI, Invitrogen, Cat. No. P3566) was added and mixed thoroughly to identify dead cells. After 15 minutes, cells were analyzed by flow cytometry using a FACSCanto II cytometer. The bispecific antibody-mediated cytotoxicity can be defined as the percentage of PI-positive target cells in Far Red-positive target cells. EC50 of T cell engaged cytotoxicity were determined using Prism software (GraphPad Software, Inc.).

Mass Spectrometry Characterization

The protein was diluted to 0.4 mg/mL and de-glycosylated by incubation with 1 µL of PNGase F (Glyko, GKE-5006D) (protein to enzyme ratio 40:1) in 100 µL of 20 mM Tris buffer (pH 8.0) at 37° C. for at least 4 hours. A aliquot of de-glycosylated bispecific antibodies were partially reduced by addition of 2 µL 1M DTT to final concentration of 20 mM at room temperature for 15 minutes. Each sample at 2 µg was injected onto a Acquity UPLC BEH300 C4 column (2.1×100 mm, 1.7 µm) at 0.4 mL/min. Mobile phase A was 0.1% Formic Acid (FA) in HPLC grade water. Mobile phase B was 0.1% FA in acetonitrile. For both non-reduced and reduced conditions, an efficient elution gradient of 24% B to 34% B from 3.0 to 15.0 minutes was used. After separation by RP UPLC, the mass of the bispecific protein in both non-reduced and reduced conditions were detected by Waters Xevo G2 Q-TOF. The MS signals were deconvoluted using BiophamaLynx 1.3 software. Theoretical mass-averaged molecular weights of the light chain and heavy chain components were determined using the GPMaw program (v. 6.00).

Thermostability Test by DSF

A DSF assay was performed using 7500 Fast Real-Time PCR system (Applied Biosystems). Briefly, 19 μL of antibody solution was mixed with 1 μL of 62.5×SYPRO Orange solution (Invitrogen) and added to a 96 well plate (Biosystems). The plate was heated from 26° C. to 95° C. at a rate of 2° C./min, and the resulting fluorescence data were collected. The negative derivatives of the fluorescence changes with respect to different temperatures were calculated, and the maximal value was defined as melting temperature $T_h$. If a protein has multiple unfolding transitions, the first two $T_h$ were reported, named as $T_{h1}$ and $T_{h2}$. $T_{h1}$ is always interpreted as the formal melting temperature $T_m$ to facilitate comparisons between different proteins. Data collection and $T_h$ calculation were conducted automatically by its operation software. Once the plot of negative derivatives of different temperatures was reported by the software, the point in the plot where the curve starts to decrease from a pre-transition baseline could be roughly estimated as the onset temperature $T_{on}$.

Example 13: O-Glycan Identification

Previous mass spectrometry data discovered O-glycans on the TCR-modified T3 light chain. Unlike N-glycosylation sites, which can be located based on amino acid sequence patterns, O-glycosylation sites are difficult to predict from the sequence. This T3 TCR-chimeric light chain was composed of the V region of the T3 parental antibody as well as the constant region of TCR alpha chain. Both regions could potentially have O-glycosylation sites. Mass spectrometry analysis was conducted again on the original T3 monoclonal antibody and it was found that this parental antibody was free of O-glycans, which indicated that the O-glycans were located in the TCR alpha constant region.

It is known that O-glycosylation mostly happens on Ser or Thr residues, and there are 21 Ser/Thr residues in the sequence of the TCR alpha constant region (shown in bold in the sequence below). To locate the exact position of the O-glycosylation sites, Ala scanning was carried out to substitute each individual Ser/Thr with Ala, and 21 TCR-modified monospecific T3 molecules were constructed. The potential O-glycans on each mutant were released from the protein, labeled with 2-amino benzoic acid and quantified by HPLC coupled with Fluorescence Detector. The loss of O-glycan signal could guide us the location of O-glycosylation site.

```
                                         (SEQ ID NO: 411)
  1           11          21          31
PDIQNPDPAV  YQLRDSKSSD  KSVCLFTDFD  SQTQVSQSKD 41          51          61          71
SDVYITDKCV  LDMRSMDFKS  NSAVAWSQKS  DFACANAFQN 81          91
SIIPEDTFFP  SPESS
```

In order to identify and quantify the amount of O-glycan, an acidic hydrolysis and HPLC based method was developed. The sample was hydrolyzed by 2M TFA (Trifluoroacetic Acid) and the monosaccharide of the O-glycans was released. The released GalN (Galactosamine) from GalNAc (N-Acetyl-D-galactosamine) of the O-glycan and Gal (Galactose) was labeled with 2-amino benzoic acid and analyzed by HPLC coupled with FLD (Fluorescence Detector) detector and quantified by an external calibration curve. The released GalN content was directly correlated to the amount of O-glycan as it is the specific monosaccharide to the O-glycans. The results reported the amount of mol GalN per mol protein which stands for one mol protein contains the amount of mol O-glycan.

Table 34 shows the quantified O-glycan levels on all mutants. Bispecific molecule E17-Design_2-QQQQ was used as a control protein. The data showed that there were 0.24 mol O-glycans available on each mole of E17-Design_2-QQQQ protein. Since this is a bispecific antibody having only one TCR-modified T3 light chain, the total O-glycan level of two chains should be doubled, i.e. at around 0.48 mol/mol. Among all the 21 mutants, most of them kept the expected O-glycan quantity. Samples #3, #8, #10 and #20 had slight signal decrease. Sample #19 exhibited obvious O-glycan loss. The signal was even lower than that from the control protein. Therefore position S91 was identified as the major O-glycosylation site. S19, S36, S41 and S94 were identified as possible O-glycosylation sites.

TABLE 34

Quantified O-glycans on various single Ala mutants (residue numbering was listed in FIG. 19A)

| Project NO. Test Item | WBP3438 Monosaccharide Analysis | Analytical NO. AS1803474 SOP NO. PD-PAS-LAB-090-02 Test Result(mol/mol protein) |
|---|---|---|
| Sample No. Sample ID | | Galactosamine |
| 196388 E17-Design_2-QQQQ | | 0.24 (x2) |
| 1 T3.uIgG4.SP(S16A) | | 0.41 |
| 2 T3.uIgG4.SP(S18A) | | 0.43 |
| 3 T3.uIgG4.SP(S19A) | | 0.38 |
| 4 T3.uIgG4.SP(S22A) | | 0.45 |
| 5 T3.uIgG4.SP(T27A) | | 0.57 |
| 6 T3.uIgG4.SP(S31A) | | 0.44 |
| 7 T3.uIgG4.SP(T33A) | | 0.42 |
| 8 T3.uIgG4.SP(S36A) | | 0.36 |
| 9 T3.uIgG4.SP(S38A) | | 0.47 |
| 10 T3.uIgG4.SP(S41A) | | 0.37 |
| 11 T3.uIgG4.SP(T46A) | | 0.50 |
| 12 T3.uIgG4.SP(S55A) | | 0.43 |
| 13 T3.uIgG4.SP(S60A) | | 0.53 |
| 14 T3.uIgG4.SP(S62A) | | 0.56 |
| 15 T3.uIgG4.SP(S67A) | | 0.57 |

TABLE 34-continued

Quantified O-glycans on various single Ala mutants (residue numbering was listed in FIG. 19A)

| Project NO. | WBP3438 | Analytical NO. | AS1803474 |
|---|---|---|---|
| Test Item | Monosaccharide Analysis | SOP NO. | PD-PAS-LAB-090-02 |
| | | Test Result(mol/mol protein) | |

| Sample No. | Sample ID | Galactosamine |
|---|---|---|
| 16 | T3.uIgG4.SP(S70A) | 0.52 |
| 17 | T3.uIgG4.SP(S81A) | 0.53 |
| 18 | T3.uIgG4.SP(T87A) | 0.55 |
| 19 | T3.uIgG4.SP(S91A) | 0.12 |
| 20 | T3.uIgG4.SP(S94A) | 0.32 |
| 21 | T3.uIgG4.SP(S95A) | 0.61 |

Example 14: Binding to Fcγ Receptor, C1q, and FcRn

Methods

Fcγ Receptor Binding Affinity by SPR

Antibody binding affinity to FcγRs was detected using Biacore T200 (or Biacore 8K). Each receptor was captured on an anti-his antibody immobilized CM5 sensor chip (GE). Antibodies at different concentrations were injected over the sensor chip at a flow rate of 30 uL/min for an association phase of 60 s, followed by 60 s dissociation. The chip was then regenerated by 10 mM glycine (pH 1.5) after each binding cycle.

The sensorgrams of blank surface and buffer channel were subtracted from the test sensorgrams. The experimental data was fitted by 1:1 model using Langmiur analysis (for FcγRI) or steady state model (for other receptors). Molecular weight of 150 KDa was used to calculate the molar concentration of antibodies.

C1q Binding by ELISA

ELISA Plates (Nunc) were coated with antibody samples at 3 μg/mL overnight at 4° C. After blocking and washing, C1q was gradient diluted starting from 600 μg/mL and incubated at room temperature for 2 hr. The plates were then washed and subsequently incubated with sheep anti-human C1q Ab-HRP for 1 hr. After washing, TMB substrate was added and the interaction was stopped by 2 M HCl. The absorbance at 450 nm was read using a microplate reader (Molecular Device).

FcRn Binding Affinity by SPR

Antibody binding affinity to FcRn was detected using Biacore T200 (or Biacore 8K). Each antibody was immobilized on CM5 sensor chip (GE). FcRn at different concentrations in running buffer (50 mM Na2HPO4/NaH2PO4, 150 mM NaCl, 0.05% Tween20, pH 6.0) were injected over the sensor chip at a flow rate of 30 uL/min for an association phase of 60 s, followed by 60 s dissociation. The chip was then regenerated by 1×PBS (pH 7.4) after each binding cycle.

The sensorgrams of blank surface and buffer channel were subtracted from the test sensorgrams. The experimental data was fitted by steady state model. A molecular weight of 45 KDa was used to calculate the molar concentration of FcRn.

Results

As all the IgG1s mentioned above were IgG1 with LALA mutation, the binding activity of E17-Design_2-QQQQ in both IgG4 and wild type IgG1 (T3U4.E17-2.(2).uIgG1 (wild type IgG1 with knobs-into-holes)) to FcγRI, FcγRIIa (H167), FcγRIIa (R167), FcγRIIb, FcγRIIIa (F176), FcγRIIIa (V176) and FcγRIIIb were investigated by SPR.

Relevant sequences of the T3U4.E17-2.(2).uIgG1 construct are provided below.

| | | |
|---|---|---|
| T3U4.E17-2.(2).uIgG1 | U4-LC (SEQ ID NO: 371) | DIQLTQSPSFLSASVGDRVTITCSASSTVNYMHWYQQKPGKAPKLLIYS TSNLASGVPSRFSGSGSGTEFTLTISSLQPEDFATYYCHQWSSYPYTFGQ GTKLEIKRTVAAPSVFIFPPSDEQLKSGTASVVCLLNNFYPREAKVQWK VDNALQSGNSQESVTEQDSKDSTYSLSSTLTLSKADYEKHKVYACEVT HQGLSSPVTKSFNRGEC |
| | U4-HC (SEQ ID NO: 372) | QMQLVQSGPEVKKPGTSVKVSCKASGYAFTSYNMYWVRQARGQRLE WIGYIDPYNGDTTYNQKFKGRVTITRDMSTSTAYMELSSLRSEDTAVY YCLTTAYAMDYWGQGTLVTVSSASTKGPSVFPLAPSSKSTSGGTAALG CLVKDYFPEPVTVSWNSGALTSGVHTFPAVLQSSGLYSLSSVVTVPSSS LGTQTYICNVNHKPSNTKVDKRVEPKSCDKTHTCPPCPAPELLGGPSVF LFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTIS KAKGQPREPQVCTLPPSREEMTKNQVSLSCAVKGFYPSDIAVEWESNG QPENNYKTTPPVLDSDGSFFLVSKLTVDKSRWQQGNVFSCSVMHEALH NHYTQKSLSLSPGK |
| | T3-LC (SEQ ID NO: 373) | DIVMTQSPDSLAVSLGERATINCKSSQSLLNSRTRKNYLAWYQQKPGQ PPKLLIYWASTRQSGVPDRFSGSGSGTDFTLTISSLQAEDVAVYYCTQS HTLRTFGGGTKVEIKPDIQNPDDPAVYQLRDSKSSDKSVCLFTDFDSQTQ VSQSKDSDVYITDKCVLDMRSMDFKSNSAVAWSQKSDFACANAFQNS IIPEDTFFPSPESS |
| | T3-HC (SEQ ID NO: 374) | QVQLVQSGAEVKKPGSSVKVSCKASGFAFTDYYIHWVRQAPGQGLEW MGWISPGNVNTKYNENFKGRVTITADKSTSTAYMELSSLRSEDTAVYY CARDGYSLYYFDYWGQGTLVTVLEDLKNVFPPEVAVFEPSEAEISHTQ KATLVCLATGFYPDHVELSWWVNGKEVHSGVCTDPQPLKEQPALQDS RYALSSRLRVSATFWQNPRNHFRCQVQFYGLSENDEWTQDRAKPVTQI |

```
VSAEAWGRASDKTHTCPPCPAPELLGGPSVFLFPPKPKDTLMISRTPEV
TCVVVDVSHEDPEVKFNWYVDGVEVHNAKTKPREEQYNSTYRVVSVL
TVLHQDWLNGKEYKCKVSNKALPAPIEKTISKAKGQPREPQVYTLPPC
REEMTKNQVSLWCLVKGFYPSDIAVEWESNGQPENNYKTTPPVLDSDG
SFFLYSKLTVDKSRWQQGNVFSCSVMHEALHNHYTQKSLSLSPGK
```

The affinities were summarized in Table 35 (IgG4) and Table 36 (wild type IgG1). Both molecules showed typical human IgG4 and wild type IgG1 binding affinity to all the Fcγ receptors.

TABLE 35

IgG4 Affinity to Fc receptor by SPR

| Fc receptor | $K_D$ (M) |
|---|---|
| FcγRI | 9.79E−09 |
| FcγRIIa (H167) | 2.05E−05 |
| FcγRIIa (R167) | 1.58E−05 |
| FcγRIIb | 2.41E−05 |
| FcγRIIIa (F176) | 2.93E−05 |
| FcγRIIIa (V176) | 1.40E−05 |
| FcγRIIIb | >4.10E−05 |

TABLE 36

Wild type IgG1 Affinity to Fc receptor by SPR

| Fc receptor | $K_D$ (M) |
|---|---|
| FcγRI | 1.30E−09 |
| FcγRIIa (H167) | 3.58E−06 |
| FcγRIIa (R167) | 4.83E−06 |
| FcγRIIb | 8.07E−06 |
| FcγRIIIa (F176) | 2.08E−06 |
| FcγRIIIa (V176) | 6.44E−07 |
| FcγRIIIb | 5.16E−06 |

Figure 21A:
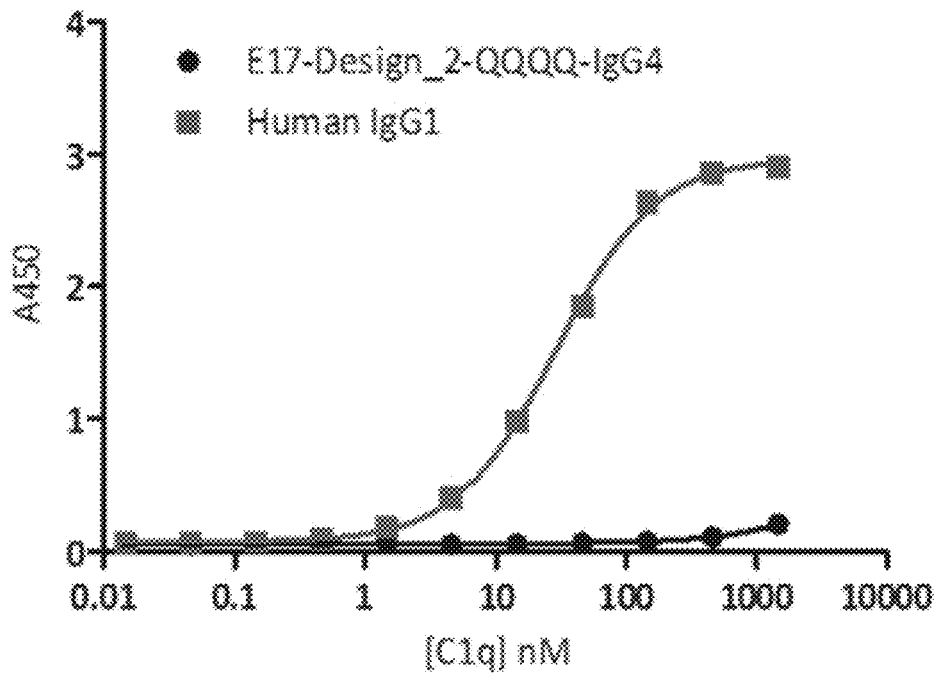
FIGS. 21A-21B show bindings of E17-Design_2-QQQQ in both IgG4 (FIG. 21A) and wild type IgG1 (FIG. 21B) formats to human C1Q by ELISA. A human IgG1 antibody was used as control.
Figure 21B:
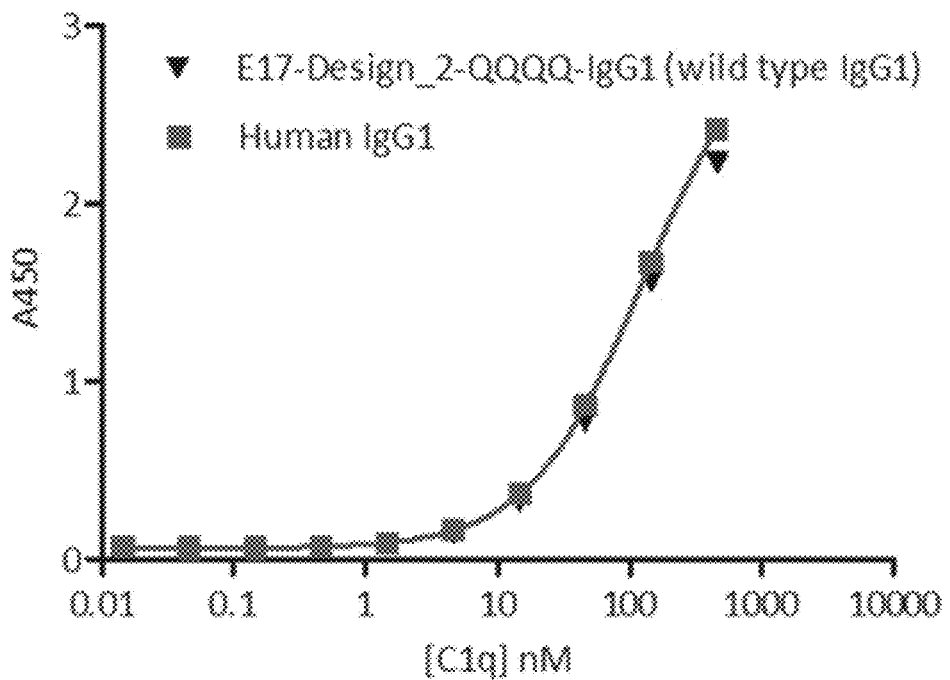

The binding activity of antibodies to C1Q was tested by ELISA (FIGS. 21A-21B). E17-Design_2-QQQQ in IgG4 showed no binding signal in ELISA (FIG. 21A), while the E17-Design_2-QQQQ in wild type IgG1 and the control human IgG1 antibody showed normal binding signal (FIG. 21B).

Example 15: Symmetric Formats G19, G19R, G25, G25R

Antibody Therapeutic targets like CD3×CD19 benefit from a bispecific antibody with monovalent CD3 binding, due to safety concerns. With this in mind, asymmetric bispecific formats E17 and F16 via integrating the WuXi-Body Fab as well as the knobs-into-holes techniques were designed and successfully generated. Some bispecific targets like CTLA-4×PD-1, however, benefit from a symmetric format, which can assemble two different antibodies while keeping their original valances (i.e. tetravalent in total) to achieve desired synergetic effects. The core unit of WuXi-Body is a chimeric Fab, which can be easily incorporated into both asymmetric and symmetric formats to assure the correct pairing of cognate light-heavy chains. Four WuXi-Bodybased symmetric formats, named G19, G19R, G25 and G25R were designed.

FIG. 22 provides a schematic description of four symmetric formats. In G19 and G25, two WuXiBody chimeric Fabs were grafted at the c-terminus and n-terminus of a normal antibody, respectively. The difference between G19 and G19R, or between G25 and G25R, is the reversed locations of the normal and chimeric Fab in each individual format. The heavy parts of two Fabs as well as the IgG-Fc were integrated into one chain, while both light chains were free to fold and assemble independently. When three vectors were co-transfected into host cells, heavy-heavy association were expected to take place like normal antibodies during expression process, while each light chain was expected to self-assemble to its own cognate partner on the heavy chain.

The bispecific CTLA-4×PD-1 antibodies in symmetric WuXiBody format were designed. A novel anti-PD-1 antibody W3055_1.153.7 (named as U6) and a commercial anti-CTLA-4 antibody ipilimumab (named as T1) were adopted to plug in the new formats. IgG4 isotype was chosen to assure the depletion of ADCC and CDC effect on the molecule. Because both U6 and T1 could be put on the top or bottom side of the format (named as U6T1 and T1U6, respectively), single format G19 was firstly used to investigate both cases.

Relevant sequences of the tested WuXiBody are provided below:

| Samples | Plasmid No | Sequences |
|---|---|---|
| T1U6.G1 9.IgG4 | T1-LC (SEQ ID NO: 375) | EIVLTQSPGTLSLSPGERATLSCRASQSVGSSYLAWYQQKPGQAPRLLIYGAFSR ATGIPDRFSGSGSGTDFTLTISRLEPEDFAVYYCQQYGSSPWTFGQGTKVEIKRT VAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC |
| | T1-U6-HC (SEQ ID NO: 376) | QVQLVESGGGVVQPGRSLRLSCAASGFTFSSYTMHWVRQAPGKGLEWVTFIS YDGNNKYYADSVKGRFTISRDNSKNTLYLQMNSLRAEDTAIYYCARTGWLGP FDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDRKPSNTK VDKRVESKYGPPCPPCPAPEFLGGPSVFLFPPKPKDTLMISRTPEVTCVVVDVSQ EDPEVQFNWYVDGVEVHNAKTKPREEQFNSTYRVVSVLTVLHQDWLNGKEY KCKVSNKGLPSSIEKTISKAKGQPREPQVYTLPPSQEEMTKNQVSLTCLVKGFY PSDIAVEWESNGQPENNYKTTPPVLDSDGSFFLYSRLTVDKSRWQEGNVFSCS VMHEALHNHYTQKSLSLSLGGGGSGGGGSGGGGSGGGGSEVQLLESGGGLV QPGGSLRLSCAASGFTFSSHAMSWVRQAPGKGLEWVSTITGGGGSIYYADSVK |

| Samples | Plasmid No | Sequences |
|---|---|---|
| | | GRFTISRDNSKNTLYLQMNSLRAEDTAVYYCAKNRAGEGYFDYWGQGTLVTV LEDLKNVFPPEVAVFEPSEAEISHTQKATLVCLATGFYPDHVELSWWVNGKEV HSGVCTDPQPLKEQPALQDSRYALSSRLRVSATFWQNPRNHFRCQVQFYGLSE NDEWTQDRAKPVTQIVSAEAWGR |
| | U6-LC (SEQ ID NO: 377) | SYELTQPLSVSVALGQTARITCGGDNIGNKDVHWYQQKPGQAPVLVIYRDSNR PSGIPEGFSGSNSGNTATLTISRAQAGDEADYYCQVWDSIWVFGGGTKLTVLPD IQNPDPAVYQLRDSKSSDKSVCLFTDFDSQTQVSQSKDSDVYITDKCVLDMRS MDFKSNSAVAWSQKSDFACANAFQNSIIPEDTFFPSPESS |
| U6T1.G1 9.IgG4 | U6-LC (SEQ ID NO: 378) | SYELTQPLSVSVALGQTARITCGGDNIGNKDVHWYQQKPGQAPVLVIYRDSNR PSGIPEGFSGSNSGNTATLTISRAQAGDEADYYCQVWDSIWVFGGGTKLTVLG QPKAAPSVTLFPPSSEELQANKATLVCLISDFYPGAVTVAWKADSSPVKAGVET TTPSKQSNNKYAASSYLSLTPEQWKSHKSYSCQVTHEGSTVEKTVAPTECS |
| | U6-T1-HC (SEQ ID NO: 379) | EVQLLESGGGLVQPGGSLRLSCAASGFTFSSHAMSWVRQAPGKGLEWVSTITG GGGSIYYADSVKGRFTISRDNSKNTLYLQMNSLRAEDTAVYYCAKNRAGEGY FDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDRKPSNTK VDKRVESKYGPPCPPCPAPEFLGGPSVFLFPPKPKDTLMISRTPEVTCVVVDVSQ EDPEVQFNWYVDGVEVHNAKTKPREEQFNSTYRVVSVLTVLHQDWLNGKEY KCKVSNKGLPSSIEKTISKAKGQPREPQVYTLPPSQEEMTKNQVSLTCLVKGFY PSDIAVEWESNGQPENNYKTTPPVLDSDGSFFLYSRLTVDKSRWQEGNVFSCS VMHEALHNHYTQKSLSLSLGGGGSGGGGSGGGGSGGGGSQVQLVESGGGV VQPGRSLRLSCAASGFTFSSYTMHWVRQAPGKGLEWVTFISYDGNNKYYADS VKGRFTISRDNSKNTLYLQMNSLRAEDTAIYYCARTGWLGPFDYWGQGTLVT VLEDLKNVFPPEVAVFEPSEAEISHTQKATLVCLATGFYPDHVELSWWVNGKE VHSGVCTDPQPLKEQPALQDSRYALSSRLRVSATFWQNPRNHFRCQVQFYGLS ENDEWTQDRAKPVTQIVSAEAWGR |
| | T1-LC (SEQ ID NO: 380) | EIVLTQSPGTLSLSPGERATLSCRASQSVGSSYLAWYQQKPGQAPRLLIYGAFSR ATGIPDRFSGSGSGTDFTLTISRLEPEDFAVYYCQQYGSSPWTFGQGTKVEIKPD IQNPDPAVYQLRDSKSSDKSVCLFTDFDSQTQVSQSKDSDVYITDKCVLDMRS MDFKSNSAVAWSQKSDFACANAFQNSIIPEDTFFPSPESS |
| U6T1.G1 9R.IgG4 | U6-LC (SEQ ID NO: 381) | SYELTQPLSVSVALGQTARITCGGDNIGNKDVHWYQQKPGQAPVLVIYRDSNR PSGIPEGFSGSNSGNTATLTISRAQAGDEADYYCQVWDSIWVFGGGTKLTVLPD IQNPDPAVYQLRDSKSSDKSVCLFTDFDSQTQVSQSKDSDVYITDKCVLDMRS MDFKSNSAVAWSQKSDFACANAFQNSIIPEDTFFPSPESS |
| | U6-T1-HC (SEQ ID NO: 382) | EVQLLESGGGLVQPGGSLRLSCAASGFTFSSHAMSWVRQAPGKGLEWVSTITG GGGSIYYADSVKGRFTISRDNSKNTLYLQMNSLRAEDTAVYYCAKNRAGEGY FDYWGQGTLVTVLEDLKNVFPPEVAVFEPSEAEISHTQKATLVCLATGFYPDH VELSWWVNGKEVHSGVCTDPQPLKEQPALQDSRYALSSRLRVSATFWQNPRN HFRCQVQFYGLSENDEWTQDRAKPVTQIVSAEAWGRYGPPCPPCPAPEFLGGP SVFLFPPKPKDTLMISRTPEVTCVVVDVSQEDPEVQFNWYVDGVEVHNAKTKP REEQFNSTYRVVSVLTVLHQDWLNGKEYKCKVSNKGLPSSIEKTISKAKGQPR EPQVYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGGGG GSGGGGSGGGGSGGGGSQVQLVESGGGVVQPGRSLRLSCAASGFTFSSYTMH WVRQAPGKGLEWVTFISYDGNNKYYADSVKGRFTISRDNSKNTLYLQMNSLR AEDTAIYYCARTGWLGPFDYWGQGTLVTVSSASTKGPSVFPLAPCSRSTSESTA ALGCLVKDYFPEPVTVSWNSGALTSGVHTFPAVLQSSGLYSLSSVVTVPSSSLG TKTYTCNVDHKPSNTKVDKRV |
| | T1-LC (SEQ ID NO: 383) | EIVLTQSPGTLSLSPGERATLSCRASQSVGSSYLAWYQQKPGQAPRLLIYGAFSR ATGIPDRFSGSGSGTDFTLTISRLEPEDFAVYYCQQYGSSPWTFGQGTKVEIKRT VAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC |
| U6T1.G2 5.IgG4 | U6-LC (SEQ ID NO: 384) | SYELTQPLSVSVALGQTARITCGGDNIGNKDVHWYQQKPGQAPVLVIYRDSNR PSGIPEGFSGSNSGNTATLTISRAQAGDEADYYCQVWDSIWVFGGGTKLTVLPD IQNPDPAVYQLRDSKSSDKSVCLFTDFDSQTQVSQSKDSDVYITDKCVLDMRS MDFKSNSAVAWSQKSDFACANAFQNSIIPEDTFFPSPESS |
| | U6-T1-HC (SEQ ID NO: 385) | EVQLLESGGGLVQPGGSLRLSCAASGFTFSSHAMSWVRQAPGKGLEWVSTITG GGGSIYYADSVKGRFTISRDNSKNTLYLQMNSLRAEDTAVYYCAKNRAGEGY FDYWGQGTLVTVLEDLKNVFPPEVAVFEPSEAEISHTQKATLVCLATGFYPDH VELSWWVNGKEVHSGVCTDPQPLKEQPALQDSRYALSSRLRVSATFWQNPRN HFRCQVQFYGLSENDEWTQDRAKPVTQIVSAEAWGRGGGGSGGGGSQVQLV ESGGGVVQPGRSLRLSCAASGFTFSSYTMHWVRQAPGKGLEWVTFISYDGNN KYYADSVKGRFTISRDNSKNTLYLQMNSLRAEDTAIYYCARTGWLGPFDYWG QGTLVTVSSASTKGPSVFPLAPCSRSTSESTAALGCLVKDYFPEPVTVSWNSGA LTSGVHTFPAVLQSSGLYSLSSVVTVPSSSLGTKTYTCNVDHKPSNTKVDKRVE SKYGPPCPPCPAPEFLGGPSVFLFPPKPKDTLMISRTPEVTCVVVDVSQEDPEVQ FNWYVDGVEVHNAKTKPREEQFNSTYRVVSVLTVLHQDWLNGKEYKCKVSN |

| Samples | Plasmid No | Sequences |
|---|---|---|
| | | KGLPSSIEKTISKAKGQPREPQVYTLPPSQEEMTKNQVSLTCLVKGFYPSDIAVE WESNGQPENNYKTTPPVLDSDGSFFLYSRLTVDKSRWQEGNVFSCSVMHEAL HNHYTQKSLSLSLGK |
| | T1-LC (SEQ ID NO: 386) | EIVLTQSPGTLSLSPGERATLSCRASQSVGSSYLAWYQQKPGQAPRLLIYGAFSR ATGIPDRFSGSGSGTDFTLTISRLEPEDFAVYYCQQYGSSPWTFGQGTKVEIKRT VAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC |
| U6T1.G2 5R.IgG4 | U6-LC (SEQ ID NO: 387) | SYELTQPLSVSVALGQTARITCGGDNIGNKDVHWYQQKPGQAPVLVIYRDSNR PSGIPEGFSGSNSGNTATLTISRAQAGDEADYYCQVWDSIWVFGGGTKLTVLG QPKAAPSVTLFPPSSEELQANKATLVCLISDFYPGAVTVAWKADSSPVKAGVET TTPSKQSNNKYAASSYLSLTPEQWKSHKSYSCQVTHEGSTVEKTVAPTECS |
| | U6-T1-HC (SEQ ID NO: 388) | EVQLLESGGGLVQPGGSLRLSCAASGFTFSSHAMSWVRQAPGKGLEWVSTITG GGGSIYYADSVKGRFTISRDNSKNTLYLQMNSLRAEDTAVYYCAKNRAGEGY FDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTK VDKRVGGGSGGGGSGGGGSQVQLVESGGGVVQPGRSLRLSCAASGFTFSSYTMHWV RQAPGKGLEWVTFISYDGNNKYYADSVKGRFTISRDNSKNTLYLQMNSLRAE DTAIYYCARTGWLGPFDYWGQGTLVTVLEDLKNVFPPEVAVFEPSEAEISHTQ KATLVCLATGFYPDHVELSWWVNGKEVHSGVCTDPQPLKEQPALQDSRYALS SRLRVSATFWQNPRNHFRCQVQFYGLSENDEWTQDRAKPVTQIVSAEAWGRY GPPCPPCPAPEFLGGPSVFLFPPKPKDTLMISRTPEVTCVVVDVSQEDPEVQFNW YVDGVEVHNAKTKPREEQFNSTYRVVSVLTVLHQDWLNGKEYKCKVSNKGL PSSIEKTISKAKGQPREPQVYTLPPSQEEMTKNQVSLTCLVKGFYPSDIAVEWES NGQPENNYKTTPPVLDSDGSFFLYSRLTVDKSRWQEGNVFSCSVMHEALHNH YTQKSLSLSLGK |
| | T1-LC (SEQ ID NO: 389) | EIVLTQSPGTLSLSPGERATLSCRASQSVGSSYLAWYQQKPGQAPRLLIYGAFSR ATGIPDRFSGSGSGTDFTLTISRLEPEDFAVYYCQQYGSSPWTFGQGTKVEIKPD IQNPDPAVYQLRDSKSSDKSVCLFTDFDSQTQVSQSKDSDVYITDKCVLDMRS MDFKSNSAVAWSQKSDFACANAFQNSIIPEDTFFPSPESS |
| U6T4.G2 6.IgG4 | U6-LC (SEQ ID NO: 390) | SYELTQPLSVSVALGQTARITCGGDNIGNKDVHWYQQKPGQAPVLVIYRDSNR PSGIPEGFSGSNSGNTATLTISRAQAGDEADYYCQVWDSIWVFGGGTKLTVLPD IQNPDPAVYQLRDSKSSDKSVCLFTDFDSQTQVSQSKDSDVYITDKCVLDMRS MDFKSNSAVAWSQKSDFACANAFQNSIIPEDTFFPSPESS |
| | U6-HC T4-LC (SEQ ID NO: 391) | EVQLLESGGGLVQPGGSLRLSCAASGFTFSSHAMSWVRQAPGKGLEWVSTITG GGGSIYYADSVKGRFTISRDNSKNTLYLQMNSLRAEDTAVYYCAKNRAGEGY FDYWGQGTLVTVLEDLKNVFPPEVAVFEPSEAEISHTQKATLVCLATGFYPDH VELSWWVNGKEVHSGVCTDPQPLKEQPALQDSRYALSSRLRVSATFWQNPRN HFRCQVQFYGLSENDEWTQDRAKPVTQIVSAEAWGRGGGGSGGGGSDIVMTQ TPLSLSVTPGQPASISCRSSQSLLNSDGNTYLYWYLQKPGQSPQLLIYLVSKLGS GVPNRFSGSGSGTDFTLKISRVEAEDVGVYYCVQGTHDPWTFGGGTKVEIKRT VAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC |
| | T4-HC (SEQ ID NO: 392) | QVQLQESGPGLVKPSETLSLTCSVTYHTITSGYDWTWIRKPPGKGMEWIGYISY SGNTNYNPSLKSRVTISRDTSKNQFFLKLSSVTAADTAVYYCASMMVPHYYV MDAWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTK VDKRVESKYGPPCPPCPAPEFLGGPSVFLFPPKPKDTLMISRTPEVTCVVVDVSQ EDPEVQFNWYVDGVEVHNAKTKPREEQFNSTYRVVSVLTVLHQDWLNGKEY KCKVSNKGLPSSIEKTISKAKGQPREPQVYTLPPSQEEMTKNQVSLTCLVKGFY PSDIAVEWESNGQPENNYKTTPPVLDSDGSFFLYSRLTVDKSRWQEGNVFSCS VMHEALHNHYTQKSLSLSLGK |
| U6T5.G1 9.IgG4 | U6-LC (SEQ ID NO: 393) | SYELTQPLSVSVALGQTARITCGGDNIGNKDVHWYQQKPGQAPVLVIYRDSNR PSGIPEGFSGSNSGNTATLTISRAQAGDEADYYCQVWDSIWVFGGGTKLTVLG QPKAAPSVTLFPPSSEELQANKATLVCLISDFYPGAVTVAWKADSSPVKAGVET TTPSKQSNNKYAASSYLSLTPEQWKSHKSYSCQVTHEGSTVEKTVAPTECS |
| | U6-T5-HC (SEQ ID NO: 394) | EVQLLESGGGLVQPGGSLRLSCAASGFTFSSHAMSWVRQAPGKGLEWVSTITG GGGSIYYADSVKGRFTISRDNSKNTLYLQMNSLRAEDTAVYYCAKNRAGEGY FDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTK VDKRVESKYGPPCPPCPAPEFLGGPSVFLFPPKPKDTLMISRTPEVTCVVVDVSQ EDPEVQFNWYVDGVEVHNAKTKPREEQFNSTYRVVSVLTVLHQDWLNGKEY KCKVSNKGLPSSIEKTISKAKGQPREPQVYTLPPSQEEMTKNQVSLTCLVKGFY PSDIAVEWESNGQPENNYKTTPPVLDSDGSFFLYSRLTVDKSRWQEGNVFSCS VMHEALHNHYTQKSLSLSLGGGGGSGGGGSGGGGSGGGGSQVQLVQSGAEV KKPGSSVKVSCKASGYTFTNYFMNWVRQAPGQGLEWMGRVDPEQGRADYAE KFKKRVTITADKSTSTAYMELSSLRSEDTAVYYCARRAMDNYGFAYWGQGTL VTVLEDLKNVFPPEVAVFEPSEAEISHTQKATLVCLATGFYPDHVELSWWVNG |

| Samples | Plasmid No | Sequences |
|---|---|---|
| | | KEVHSGVCTDPQPLKEQPALQDSRYALSSRLRVSATFWQNPRNHFRCQVQFY<br>GLSENDEWTQDRAKPVTQIVSAEAWGR |
| | T5-LC<br>(SEQ ID<br>NO: 395) | EIVLTQSPDFQSVTPKEKVTITCSANSALSYMYWYQQKPDQSPKLWVHGTSNL<br>ASGVPSRFSGSGSGTDFTLTINSLEAEDAATYYCHHWSNTQWTFGGGTKVEIKP<br>DIQNPDPAVYQLRDSKSSDKSVCLFTDFDSQTQVSQSKDSDVYITDKCVLDMR<br>SMDFKSNSAVAWSQKSDFACANAFQNSIIPEDTFFPSPESS |
| U6T5.G1<br>9R.IgG4 | U6-LC<br>(SEQ ID<br>NO: 396) | SYELTQPLSVSVALGQTARITCGGDNIGNKDVHWYQQKPGQAPVLVIYRDSNR<br>PSGIPEGFSGSNSGNTATLTISRAQAGDEADYYCQVWDSIWVFGGGTKLTVLPD<br>IQNPDPAVYQLRDSKSSDKSVCLFTDFDSQTQVSQSKDSDVYITDKCVLDMRS<br>MDFKSNSAVAWSQKSDFACANAFQNSIIPEDTFFPSPESS |
| | U6-T5-HC<br>(SEQ ID<br>NO: 397) | EVQLLESGGGLVQPGGSLRLSCAASGFTFSSHAMSWVRQAPGKGLEWVSTITG<br>GGGSIYYADSVKGRFTISRDNSKNTLYLQMNSLRAEDTAVYYCAKNRAGEGY<br>FDYWGQGTLVTVLEDLKNVFPPEVAVFEPSEAEISHTQKATLVCLATGFYPDH<br>VELSWWVNGKEVHSGVCTDPQPLKEQPALQDSRYALSSRLRVSATFWQNPRN<br>HFRCQVQFYGLSENDEWTQDRAKPVTQIVSAEAWGRYGPPCPPCPAPEFLGGP<br>SVFLFPPKPKDTLMISRTPEVTCVVVDVSQEDPEVQFNWYVDGVEVHNAKTKP<br>REEQFNSTYRVVSVLTVLHQDWLNGKEYKCKVSNKGLPSSIEKTISKAKGQPR<br>EPQVYTLPPSQEEMTKNQVSLTCLVKGFYPSDIAVEWESNGQPENNYKTTPPV<br>LDSDGSFFLYSRLTVDKSRWQEGNVFSCSVMHEALHNHYTQKSLSLSLGGGG<br>GSGGGGSGGGGSGGGGSQVQLVQSGAEVKKPGSSVKVSCKASGYTFTNYFMN<br>WVRQAPGQGLEWMGRVDPEQGRADYAEKFKKRVTITADKSTSTAYMELSSL<br>RSEDTAVYYCARRAMDNYGFAYWGQGTLVTVSSASTKGPSVFPLAPCSRSTSE<br>STAALGCLVKDYFPEPVTVSWNSGALTSGVHTFPAVLQSSGLYSLSSVVTVPSS<br>SLGTKTYTCNVDHKPSNTKVDKRV |
| | T5-LC<br>(SEQ ID<br>NO: 398) | EIVLTQSPDFQSVTPKEKVTITCSANSALSYMYWYQQKPDQSPKLWVHGTSNL<br>ASGVPSRFSGSGSGTDFTLTINSLEAEDAATYYCHHWSNTQWTFGGGTKVEIK<br>RTVAAPSVFIFPPSDEQLKSGTASVVCLLNNFYPREAKVQWKVDNALQSGNSQ<br>ESVTEQDSKDSTYSLSSTLTLSKADYEKHKVYACEVTHQGLSSPVTKSFNRGEC |
| U6T5.G2<br>5.IgG4 | U6-LC<br>(SEQ ID<br>NO: 399) | SYELTQPLSVSVALGQTARITCGGDNIGNKDVHWYQQKPGQAPVLVIYRDSNR<br>PSGIPEGFSGSNSGNTATLTISRAQAGDEADYYCQVWDSIWVFGGGTKLTVLPD<br>IQNPDPAVYQLRDSKSSDKSVCLFTDFDSQTQVSQSKDSDVYITDKCVLDMRS<br>MDFKSNSAVAWSQKSDFACANAFQNSIIPEDTFFPSPESS |
| | U6-T5-HC<br>(SEQ ID<br>NO: 400) | EVQLLESGGGLVQPGGSLRLSCAASGFTFSSHAMSWVRQAPGKGLEWVSTITG<br>GGGSIYYADSVKGRFTISRDNSKNTLYLQMNSLRAEDTAVYYCAKNRAGEGY<br>FDYWGQGTLVTVLEDLKNVFPPEVAVFEPSEAEISHTQKATLVCLATGFYPDH<br>VELSWWVNGKEVHSGVCTDPQPLKEQPALQDSRYALSSRLRVSATFWQNPRN<br>HFRCQVQFYGLSENDEWTQDRAKPVTQIVSAEAWGRGGGGSGGGGSQVQLV<br>QSGAEVKKPGSSVKVSCKASGYTFTNYFMNWVRQAPGQGLEWMGRVDPEQG<br>RADYAEKFKKRVTITADKSTSTAYMELSSLRSEDTAVYYCARRAMDNYGFAY<br>WGQGTLVTVSSASTKGPSVFPLAPCSRSTSESTAALGCLVKDYFPEPVTVSWNS<br>GALTSGVHTFPAVLQSSGLYSLSSVVTVPSSSLGTKTYTCNVDHKPSNTKVDKR<br>VESKYGPPCPPCPAPEFLGGPSVFLFPPKPKDTLMISRTPEVTCVVVDVSQEDPE<br>VQFNWYVDGVEVHNAKTKPREEQFNSTYRVVSVLTVLHQDWLNGKEYKCKV<br>SNKGLPSSIEKTISKAKGQPREPQVYTLPPSQEEMTKNQVSLTCLVKGFYPSDIA<br>VEWESNGQPENNYKTTPPVLDSDGSFFLYSRLTVDKSRWQEGNVFSCSVMHE<br>ALHNHYTQKSLSLSLGK |
| | T5-LC<br>(SEQ ID<br>NO: 401) | EIVLTQSPDFQSVTPKEKVTITCSANSALSYMYWYQQKPDQSPKLWVHGTSNL<br>ASGVPSRFSGSGSGTDFTLTINSLEAEDAATYYCHHWSNTQWTFGGGTKVEIK<br>RTVAAPSVFIFPPSDEQLKSGTASVVCLLNNFYPREAKVQWKVDNALQSGNSQ<br>ESVTEQDSKDSTYSLSSTLTLSKADYEKHKVYACEVTHQGLSSPVTKSFNRGEC |
| U6T5.G2<br>5R.IgG4 | U6-LC<br>(SEQ ID<br>NO: 402) | SYELTQPLSVSVALGQTARITCGGDNIGNKDVHWYQQKPGQAPVLVIYRDSNR<br>PSGIPEGFSGSNSGNTATLTISRAQAGDEADYYCQVWDSIWVFGGGTKLTVLG<br>QPKAAPSVTLFPPSSEELQANKATLVCLISDFYPGAVTVAWKADSSPVKAGVET<br>TTPSKQSNNKYAASSYLSLTPEQWKSHKSYSCQVTHEGSTVEKTVAPTECS |
| | U6-T5-HC<br>(SEQ ID<br>NO: 403) | EVQLLESGGGLVQPGGSLRLSCAASGFTFSSHAMSWVRQAPGKGLEWVSTITG<br>GGGSIYYADSVKGRFTISRDNSKNTLYLQMNSLRAEDTAVYYCAKNRAGEGY<br>FDYWGQGTLVTVSSASTKGPSVFPLAPCSRSTSESTAALGCLVKDYFPEPVTVS<br>WNSGALTSGVHTFPAVLQSSGLYSLSSVVTVPSSSLGTKTYTCNVDHKPSNTK<br>VDKRVGGGGSGGGGSQVQLVQSGAEVKKPGSSVKVSCKASGYTFTNYFMNW<br>VRQAPGQGLEWMGRVDPEQGRADYAEKFKKRVTITADKSTSTAYMELSSLRS<br>EDTAVYYCARRAMDNYGFAYWGQGTLVTVLEDLKNVFPPEVAVFEPSEAEIS<br>HTQKATLVCLATGFYPDHVELSWWVNGKEVHSGVCTDPQPLKEQPALQDSR<br>YALSSRLRVSATFWQNPRNHFRCQVQFYGLSENDEWTQDRAKPVTQIVSAEA<br>WGRYGPPCPPCPAPEFLGGPSVFLFPPKPKDTLMISRTPEVTCVVVDVSQEDPE<br>VQFNWYVDGVEVHNAKTKPREEQFNSTYRVVSVLTVLHQDWLNGKEYKCKV |

| Samples | Plasmid No | Sequences |
|---|---|---|
| | | SNKGLPSSIEKTISKAKGQPREPQVYTLPPSQEEMTKNQVSLTCLVKGFYPSDIA VEWESNGQPENNYKTTPPVLDSDGSFFLYSRLTVDKSRWQEGNVFSCSVMHE ALHNHYTQKSLSLSLGK |
| | T5-LC (SEQ ID NO: 404) | EIVLTQSPDFQSVTPKEKVTITCSANSALSYMYWYQQKPDQSPKLWVHGTSNL ASGVPSRFSGSGSGTDFTLTINSLEAEDAATYYCHHWSNTQWTFGGGTKVEIKP DIQNPDPAVYQLRDSKSSDKSVCLFTDFDSQTQVSQSKDSDVYITDKCVLDMR SMDFKSNSAVAWSQKSDFACANAFQNSIIPEDTFFPSPESS |
| T4U6.G2 7.IgG4 | T4-HC U6-LC (SEQ ID NO: 405) | QVQLQESGPGLVKPSETLSLTCSVTYHTITSGYDWTWIRKPPGKGMEWIGYISY SGNTNYNPSLKSRVTISRDTSKNQFFLKLSSVTAADTAVYYCASMMVPHYYV MDAWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTK VDKRVESKYGPPCPPCPAPEFLGGPSVFLFPPKPKDTLMISRTPEVTCVVVDVSQ EDPEVQFNWYVDGVEVHNAKTKPREEQFNSTYRVVSVLTVLHQDWLNGKEY KCKVSNKGLPSSIEKTISKAKGQPREPQVYTLPPSQEEMTKNQVSLTCLVKGFY PSDIAVEWESNGQPENNYKTTPPVLDSDGSFFLYSRLTVDKSRWQEGNVFSCS VMHEALHNHYTQKSLSLSLGKGGGGSGGGGSGGGGSGGGGSSYELTQPLSVS VALGQTARITCGGDNIGNKDVHWYQQKPGQAPVLVIYRDSNRPSGIPEGFSGS NSGNTATLTISRAQAGDEADYYCQVWDSIWVFGGGTKLTVLPDIQNPDPAVY QLRDSKSSDKSVCLFTDFDSQTQVSQSKDSDVYITDKCVLDMRSMDFKSNSAV AWSQKSDFACANAFQNSIIPEDTFFPSPESS |
| | U6-HC (SEQ ID NO: 406) | EVQLLESGGGLVQPGGSLRLSCAASGFTFSSHAMSWVRQAPGKGLEWVSTITG GGGSIYYADSVKGRFTISRDNSKNTLYLQMNSLRAEDTAVYYCAKNRAGEGY FDYWGQGTLVTVLEDLKNVFPPEVAVFEPSEAEISHTQKATLVCLATGFYPDH VELSWWVNGKEVHSGVCTDPQPLKEQPALQDSRYALSSRLRVSATFWQNPRN HFRCQVQFYGLSENDEWTQDRAKPVTQIVSAEAWGR |
| | T4-LC (SEQ ID NO: 407) | DIVMTQTPLSLSVTPGQPASISCRSSQSLLNSDGNTYLYWYLQKPGQSPQLLIYL VSKLGSGVPNRFSGSGSGTDFTLKISRVEAEDVGVYYCVQGTHDPWTFGGGTK VEIKRTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVTKSFN RGEC |
| | T4-HC U6-LC (SEQ ID NO: 408) | QVQLQESGPGLVKPSETLSLTCSVTYHTITSGYDWTWIRKPPGKGMEWIGYISY SGNTNYNPSLKSRVTISRDTSKNQFFLKLSSVTAADTAVYYCASMMVPHYYV MDAWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTK VDKRVGGGGSGGGGSYELTQPLSVSVALGQTARITCGGDNIGNKDVHWYQQ KPGQAPVLVIYRDSNRPSGIPEGFSGSNSGNTATLTISRAQAGDEADYYCQVWD SIWVFGGGTKLTVLPDIQNPDPAVYQLRDSKSSDKSVCLFTDFDSQTQVSQSKD SDVYITDKCVLDMRSMDFKSNSAVAWSQKSDFACANAFQNSIIPEDTFFPSPES S |
| T4U6.G2 6R.IgG4 | U6-HC (SEQ ID NO: 409) | EVQLLESGGGLVQPGGSLRLSCAASGFTFSSHAMSWVRQAPGKGLEWVSTITG GGGSIYYADSVKGRFTISRDNSKNTLYLQMNSLRAEDTAVYYCAKNRAGEGY FDYWGQGTLVTVLEDLKNVFPPEVAVFEPSEAEISHTQKATLVCLATGFYPDH VELSWWVNGKEVHSGVCTDPQPLKEQPALQDSRYALSSRLRVSATFWQNPRN HFRCQVQFYGLSENDEWTQDRAKPVTQIVSAEAWGRYGPPCPPCPAPEFLGGP SVFLFPPKPKDTLMISRTPEVTCVVVDVSQEDPEVQFNWYVDGVEVHNAKTKP REEQFNSTYRVVSVLTVLHQDWLNGKEYKCKVSNKGLPSSIEKTISKAKGQPR EPQVYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLG |
| | T4-LC (SEQ ID NO: 410) | DIVMTQTPLSLSVTPGQPASISCRSSQSLLNSDGNTYLYWYLQKPGQSPQLLIYL VSKLGSGVPNRFSGSGSGTDFTLKISRVEAEDVGVYYCVQGTHDPWTFGGGTK VEIKRTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVTKSFN RGEC |

Figure 23A:
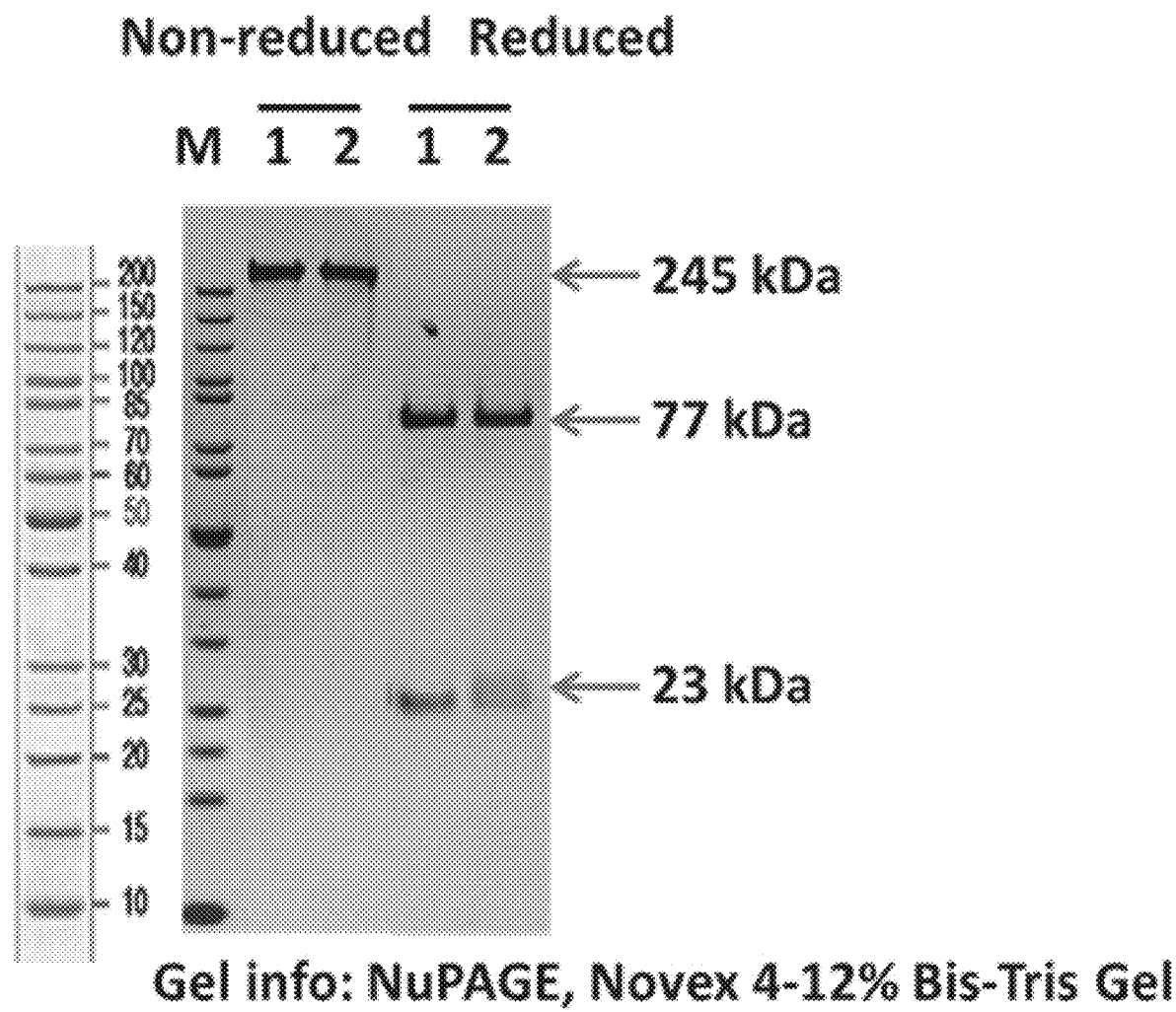
Figure 24A:
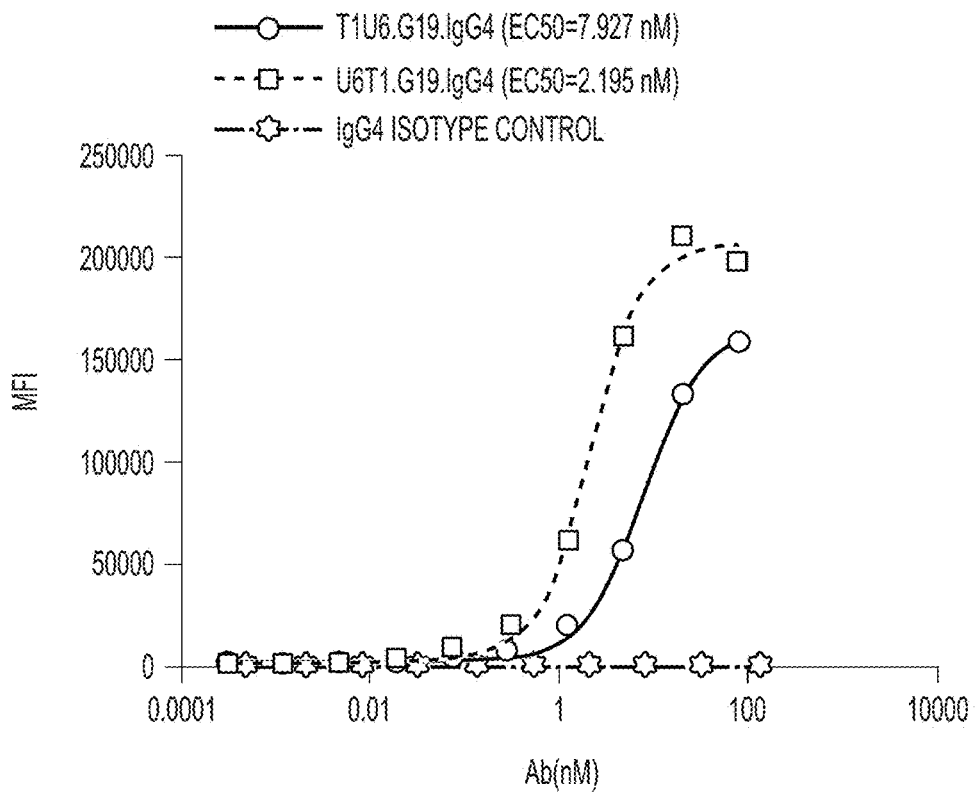
FIGS. 24A-24B show dose-dependent FACS bindings of purified U6T1 and T1U6 antibodies in G19 format to human PD-1 (FIG. 24A) and CTLA-4 (FIG. 24B) engineered cells. An IgG4 antibody was used as the negative control.
Figure 24B:
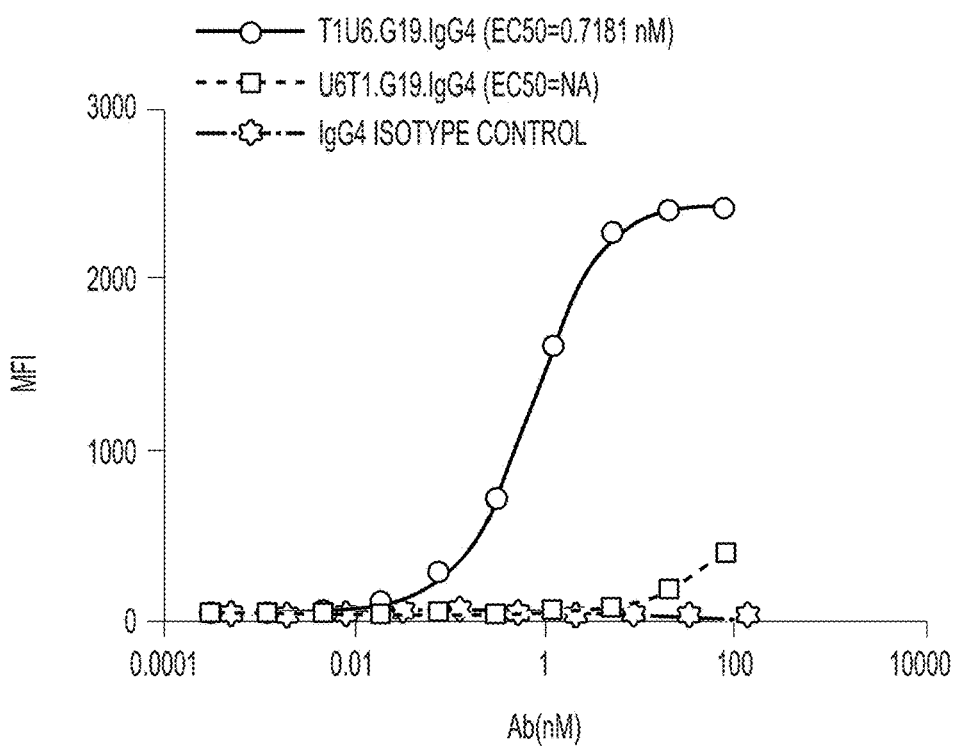

Both U6T1 and T1U6 constructs were expressed normally in Expi293 system, and the expressed protein achieved around 90% purity after one-step purification of protein A chromatography. FIGS. 23A-23B showed the SDS-PAGE and the SEC-HPLC characterizations of the purified proteins. To inspect their binding capability, cell-based binding assays to both PD-1 and CTLA-4 targets were conducted afterwards. FIGS. 24A-24B showed that both U6 and T1 had reduced binding if located at the bottom side of the format. Considering that the function of PD-1 has relatively higher importance than that of CTLA-4 (CTLA-4 antibodies are known to have more severe side effect), the PD-1 binding side was put on the top to maximize the U6 binding (i.e. U6T1, rather than T1U6), and to test how to optimize the CTLA-4 binding that is located at the bottom side.

The other three WuXiBody formats G19R, G25, and G25R (shown in FIG. 22) were further investigated. In addition, a benchmark antibody AK-104 (Akeso Biopharma, Inc), which is a PD-1/CTLA-4 bispecific antibody used in clinical trial was obtained and used as a control for direct comparison.

Figure 25A:
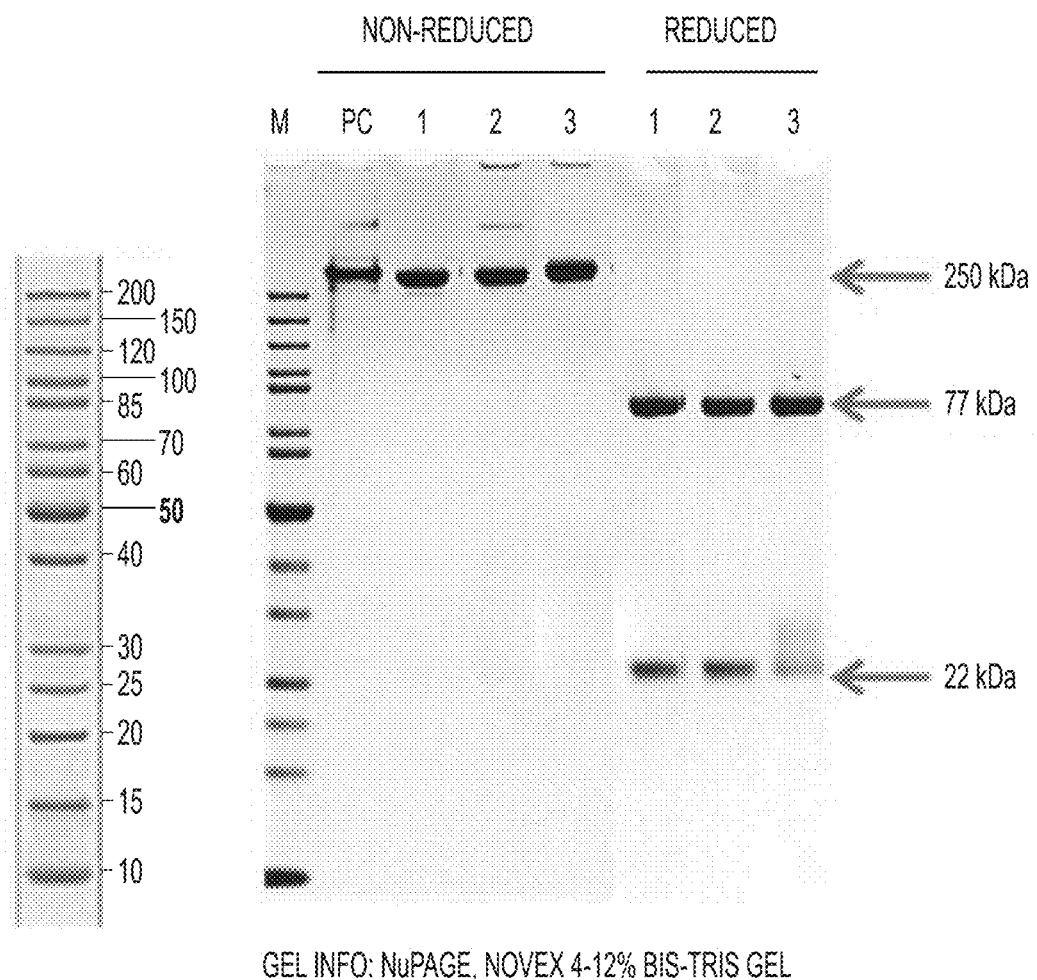
FIGS. 25A-25B show SDS-PAGE (FIG. 25A) and SEC-HPLC (FIG. 25B) characterizations of the Protein A-purified bispecific antibodies in different symmetric formats. Lanes 1-3 are the U6T1 antibody pair in G19R, G25, and G25R formats, respectively. PC is a control protein known to have 250 kD molecular weight. All of the three bispecific molecules had more than 90% purity. The lane numbers in SDS-PAGE are consistent with the label numbers in SEC-HPLC figures.
Figure 25B:
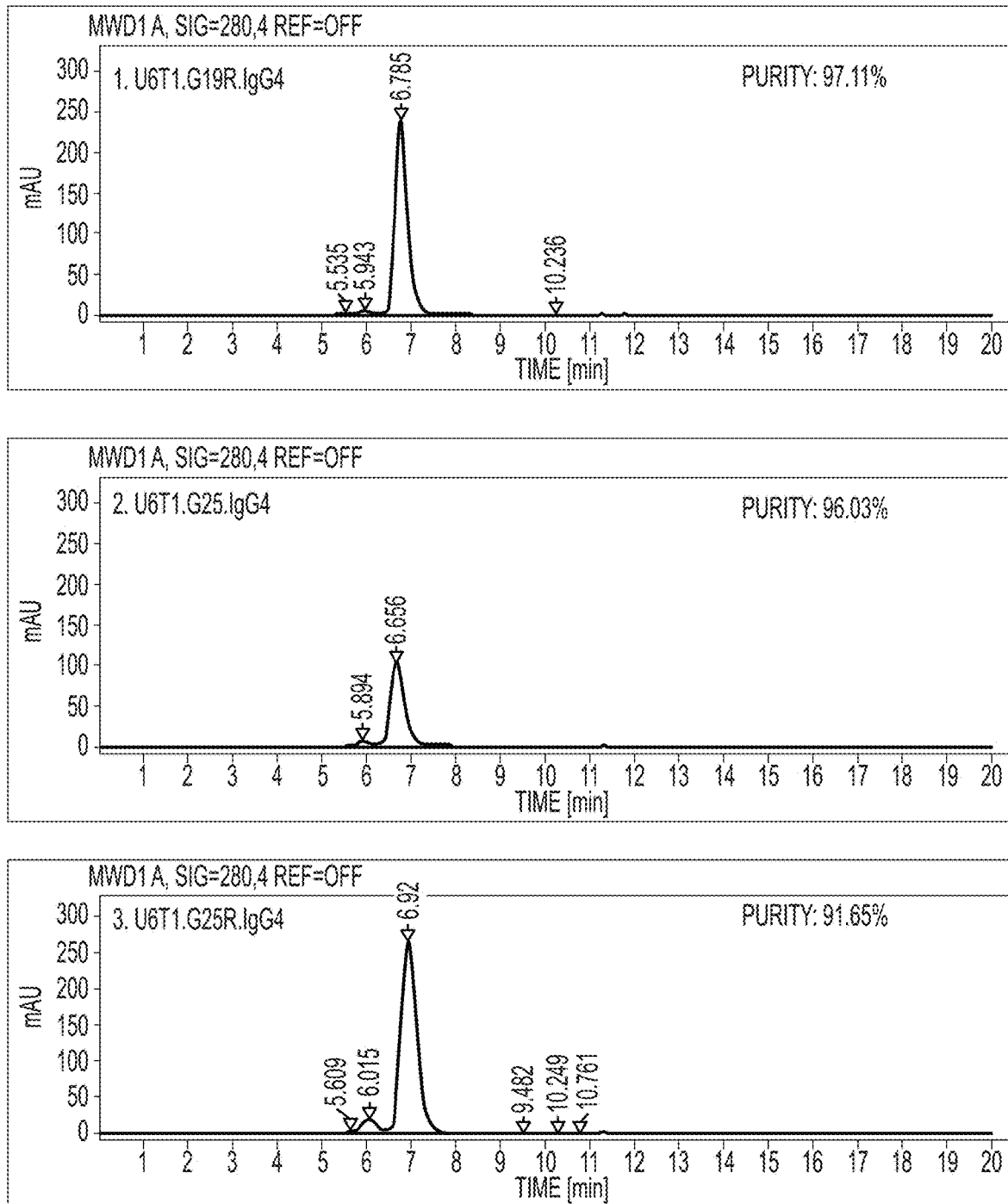

Due to the importance of PD-1 function, U6 was kept on the top side of all the formats to maximize the PD-1 binding, while T1 was kept at the bottom to realize the decent CTLA-4 binding. All the constructed molecules were well expressed in Expi293, and easily achieved >90% purity after one-step purification of protein A chromatography. FIGS. 25A-25B showed that purified proteins characterized by SDS-PAGE as well as SEC-HPLC.

Figure 26A:
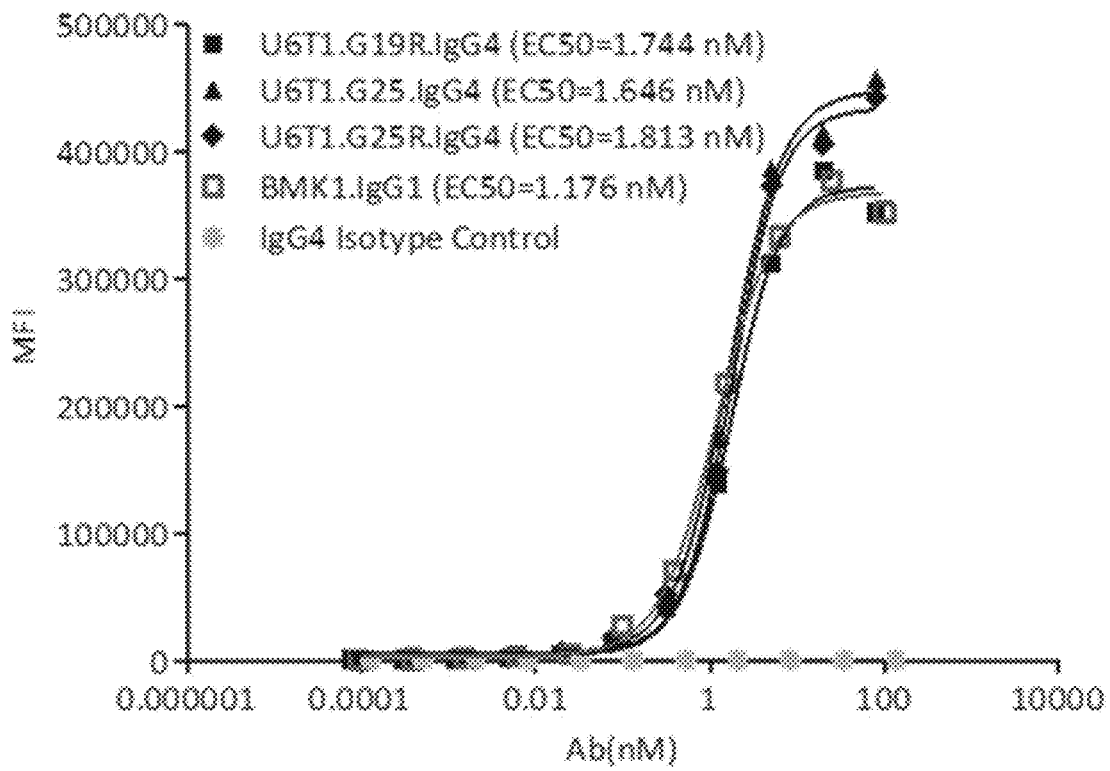
FIGS. 26A-26B show dose-dependent FACS bindings of purified U6T1 bispecific antibodies in G19R, G25, and G25R formats to human PD-1 (FIG. 26A) and CTLA-4 (FIG. 26B) engineered cells. A benchmark bispecific anti-CTAL-4×PD-1 antibody (BMK1.IgG1) was used as a control, and an IgG4 antibody was used as the negative control.
Figure 26B:
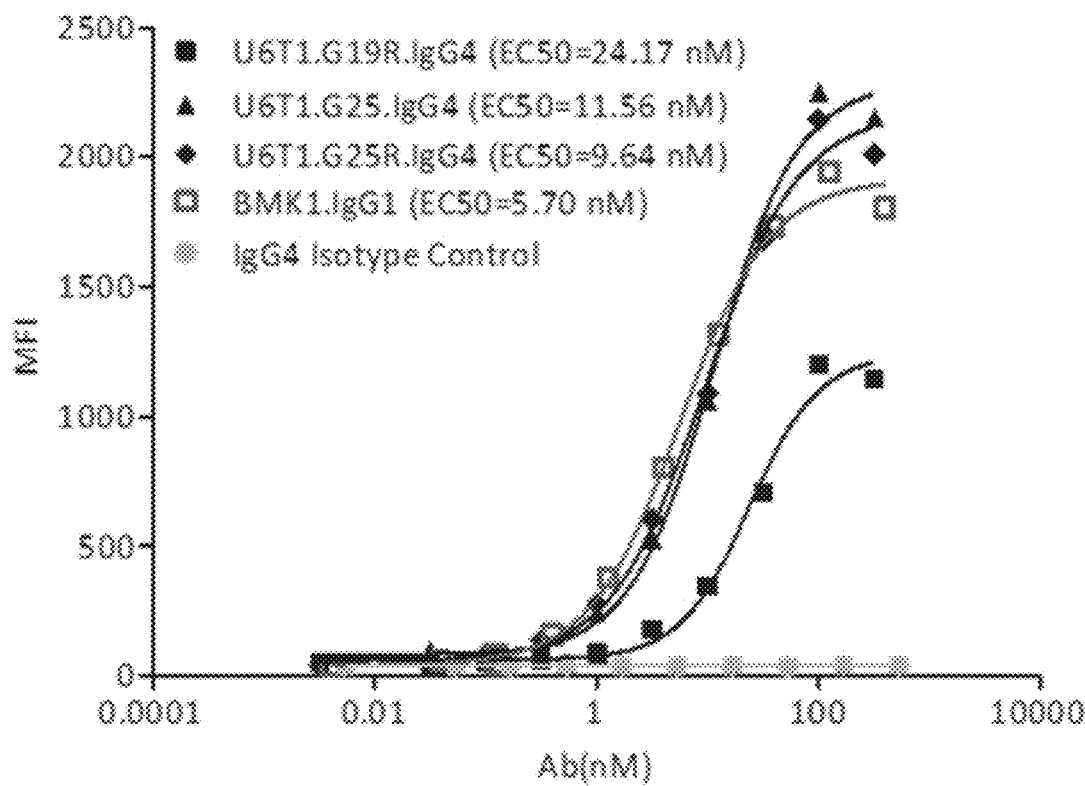

The cell-based binding assays to both PD-1 and CTLA-4 were then conducted to check the binding capability of all the new-built molecules. FIGS. 26A-26B showed the binding curve comparisons between the designed constructs and the benchmark antibody. The data showed that all of the proteins had very similar PD-1 binding to the benchmark antibody. In addition, the CTLA-4 binding significantly improved in G25 and G25R formats and achieved comparable performance to the benchmark antibody (<=2 fold). The G19R format, however, still did not work well. It is likely that G19 and G19R shared the same issue that prevented the effective binding of T1.

Figure 27A:
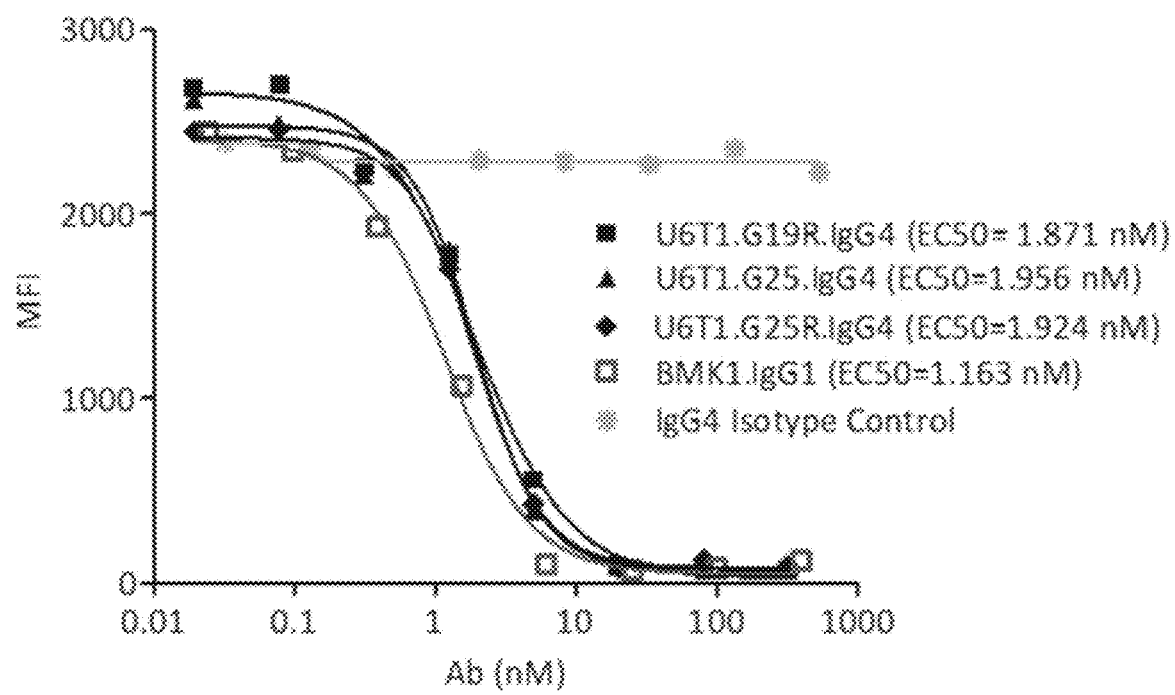
FIGS. 27A-27B show FACS competition assays of the designed bispecific antibodies in G19R, G25, and G25R formats to block human PD-L1 binding to PD-1 (FIG. 27A) and CD80 binding to CTLA-4 (FIG. 27B), respectively. A benchmark bispecific anti-CTAL-4×PD-1 antibody (BMK1.IgG1) was used as a control, and an IgG4 antibody was used as the negative control.
Figure 27B:
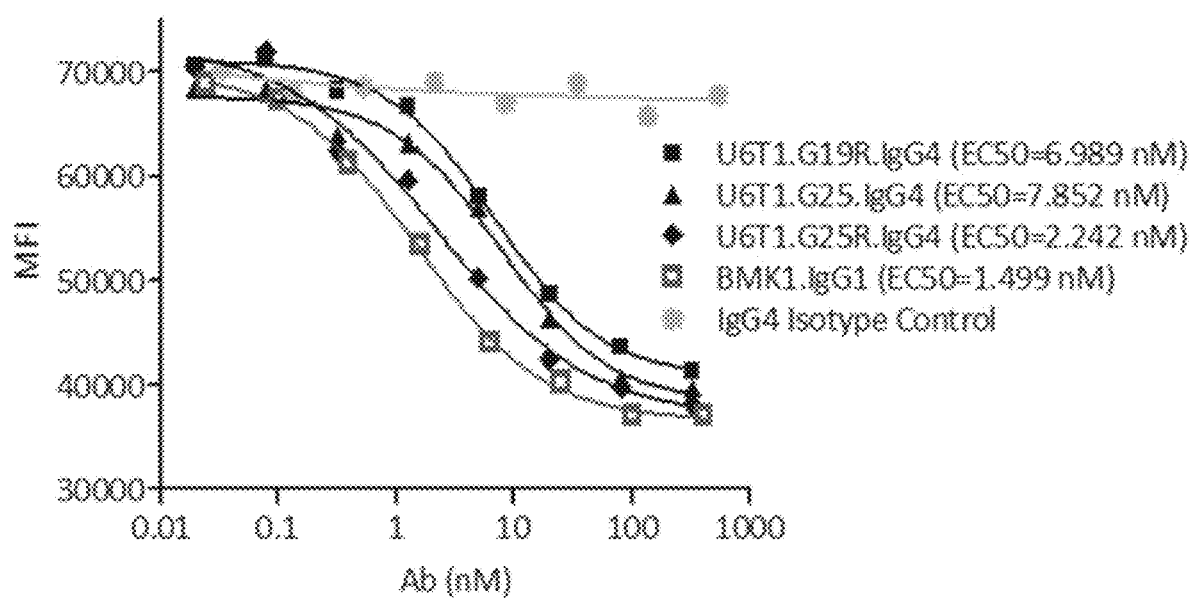

The functions of the molecules were further characterized by inspecting their competition capabilities to each ligand of two targets, PD-L1 and CD80. FIGS. 27A-27B confirmed that these molecules have comparable performance to the benchmark in competing with PD-L1. For the CTLA-4 side, the format G25R exhibited similar capability to the benchmark in competing with CD80. The other two formats had relatively worse results. The difference between G25 and G25R is the location of TCR constant region. It seems that the conversion of T1 into WuXiBody format facilitated the activity of T1, although T1 was still beneath U6. This provided a good example demonstrating that functional leads could be effectively screened out by scanning over limited number of WuXiBody derived formats.

Accordingly, a functional PD-1/CTLA-4 bispecific antibody similar to the benchmark antibody was obtained. WuXiBody formats are very universal, i.e., any new antibodies can fit into these formats and play its function. If a good parental antibody is available, it could be used to create a molecule superior to the benchmark antibody.

Figure 28A:
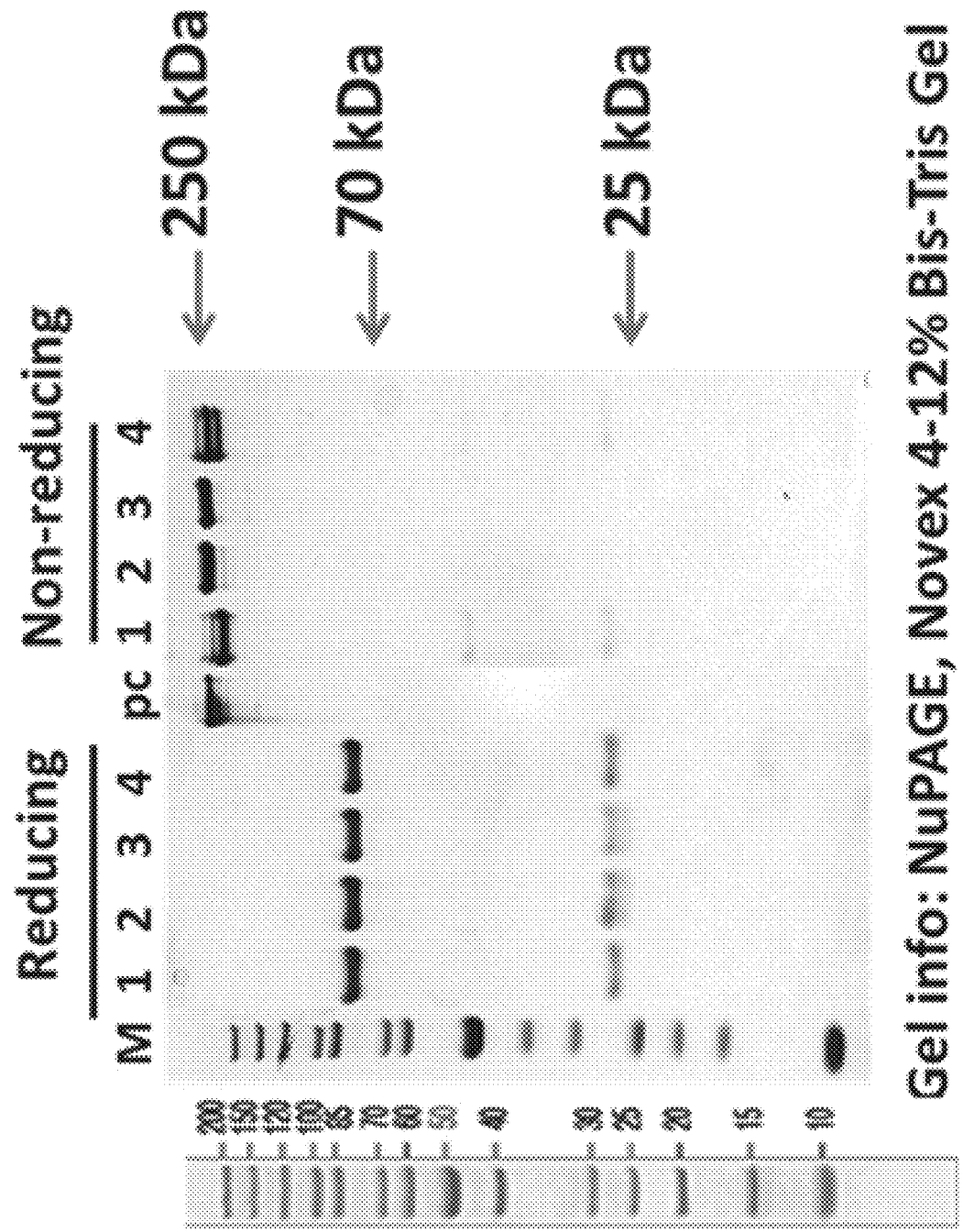
FIGS. 28A-28B show SDS-PAGE (FIG. 28A) and SEC-HPLC (FIG. 28B) characterizations of the Protein A-purified bispecific antibodies in different symmetric formats. Lanes 1-4 are the U6T5 antibody pair in G19, G19R, G25, and G25R formats, respectively. PC is a control protein with 250 kD molecular weight. All the three bispecific molecules had more than 90% purity. The lane numbers in SDS-PAGE are consistent with the label numbers in SEC-HPLC figures.
Figure 28B:
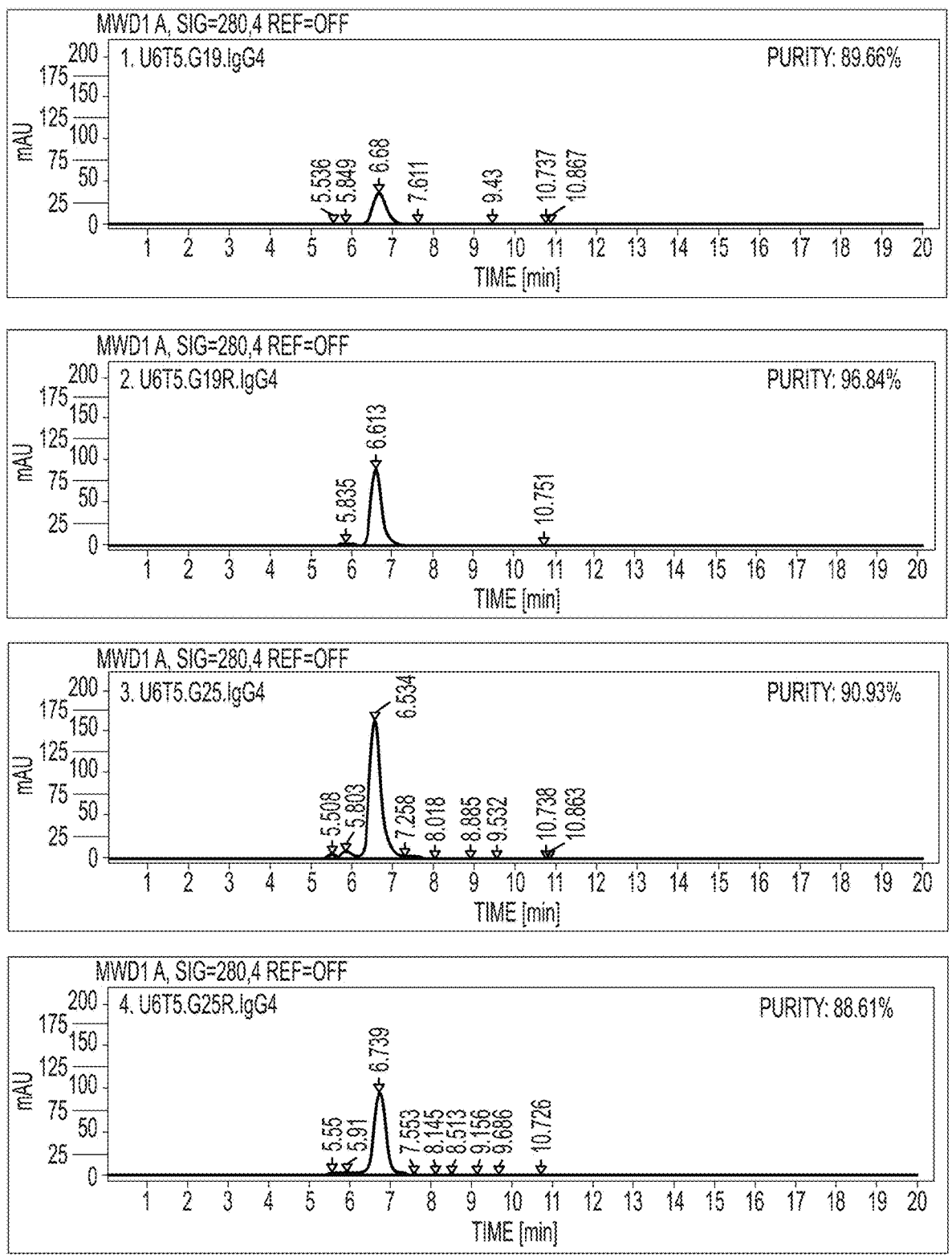

To prove the concept, another anti-CTLA-4 antibody W3162_1.154.8-z35 (named T5), which has much stronger affinity than Ipilimumab, was developed and implemented in all the four formats G19, G19R, G25, and G25R shown in FIG. 22. Again, all the new constructs were well expressed in Expi293 cells, and easily purified by one-step protein A chromatography. The purities of the proteins were shown in FIGS. 28A-28B.

Figure 29A:
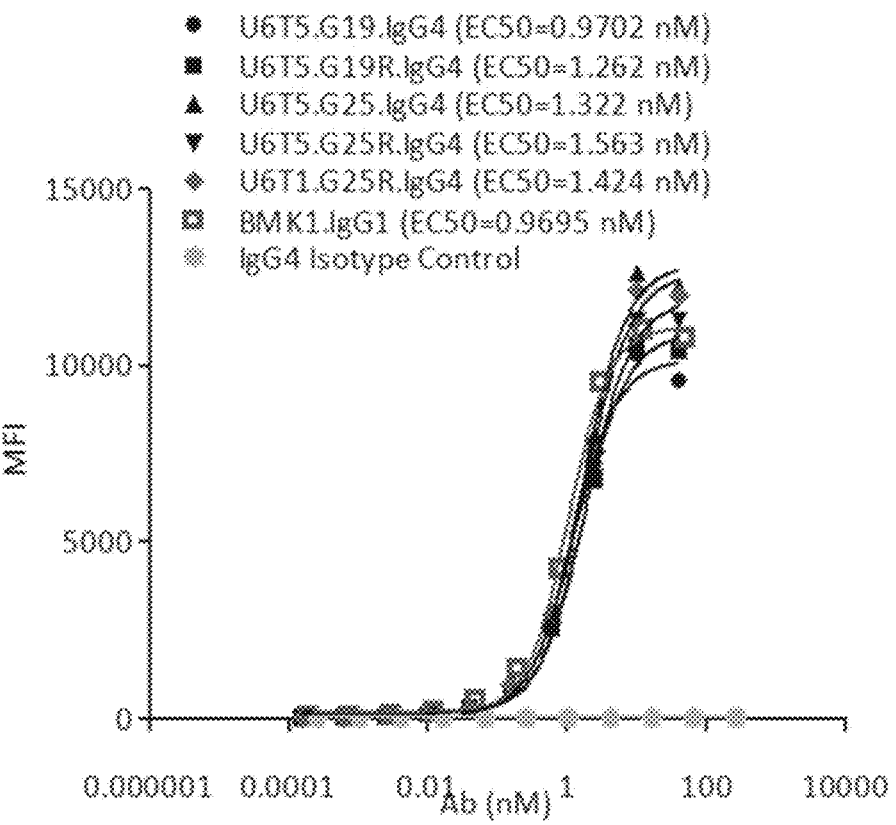
FIGS. 29A-29B show dose-dependent FACS bindings of purified bispecific antibodies in G19, G19R, G25, and G25R formats to human PD-1 (FIG. 29A) and CTLA-4 (FIG. 29B) engineered cells. A benchmark bispecific anti-CTAL-4× PD-1 antibody (BMK1.IgG1) was used as a control, and an IgG4 antibody was used as the negative control.
Figure 29B:
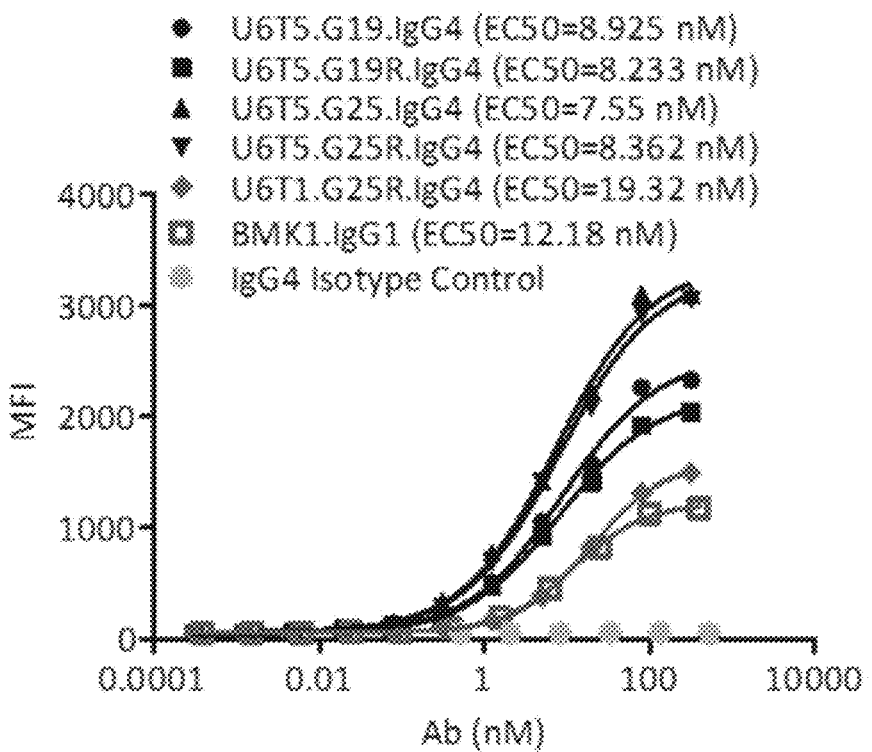
Figure 30:
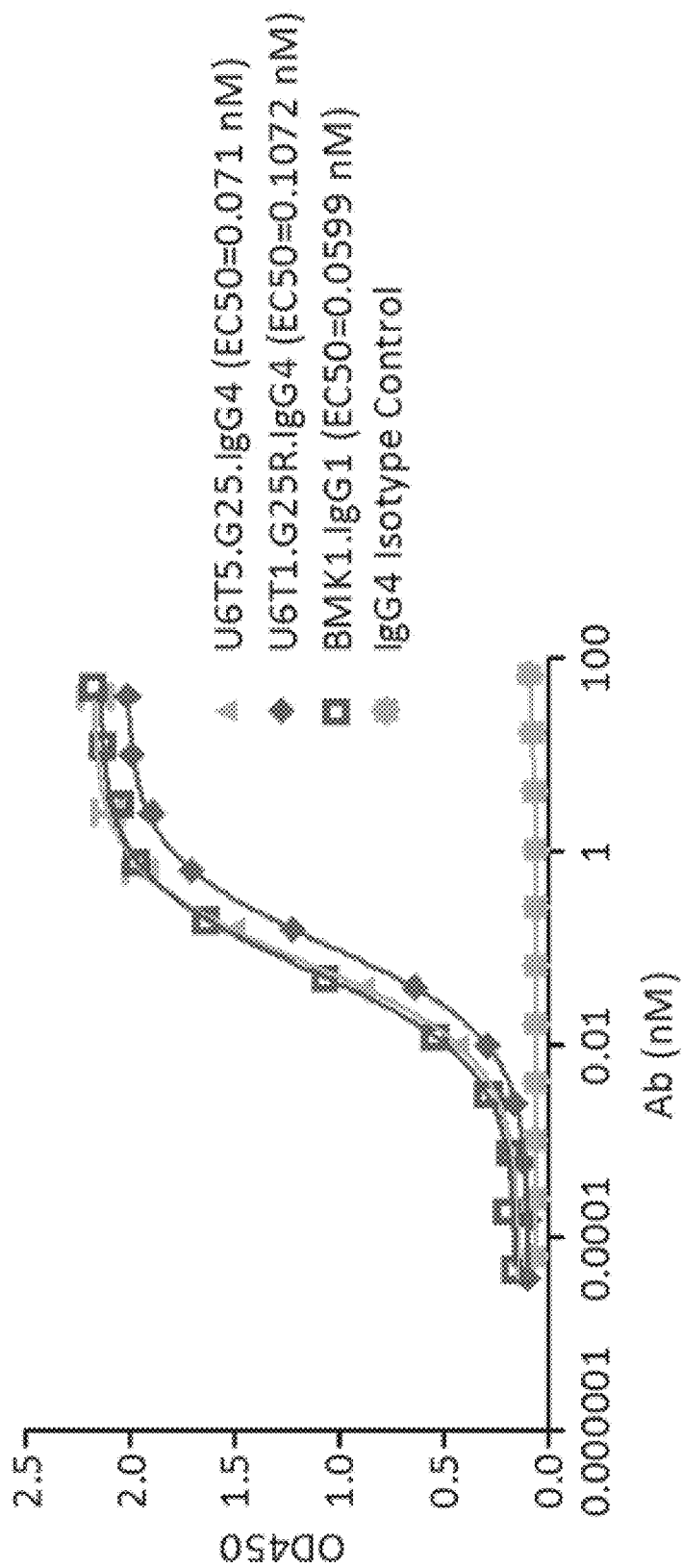
FIG. 30 shows ELISA dual binding assay of two molecules U6T5.G25 and U6T1.G25R. A benchmark bispecific anti-CTAL-4×PD-1 antibody (BMK1.IgG1) was used as a control, and an IgG4 antibody was used as the negative control.
Figure 31A:
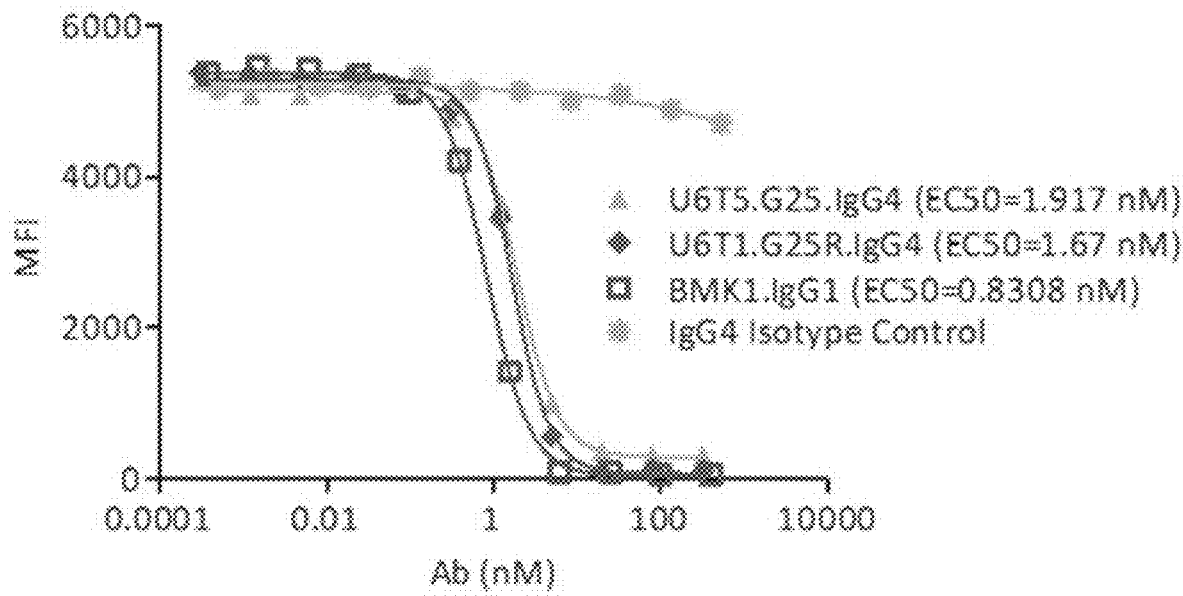
FIGS. 31A-31B show FACS competition assays of the designed bispecific antibodies U6T5.G25 and U6T1.G25R to block human PD-L1 binding to PD-1 (FIG. 31A), and CD80 binding to CTLA-4 (FIG. 31B), respectively. A benchmark bispecific anti-CTAL-4×PD-1 antibody (BMK1.IgG1) was used as a control, and an IgG4 antibody was used as the negative control.
Figure 31B:
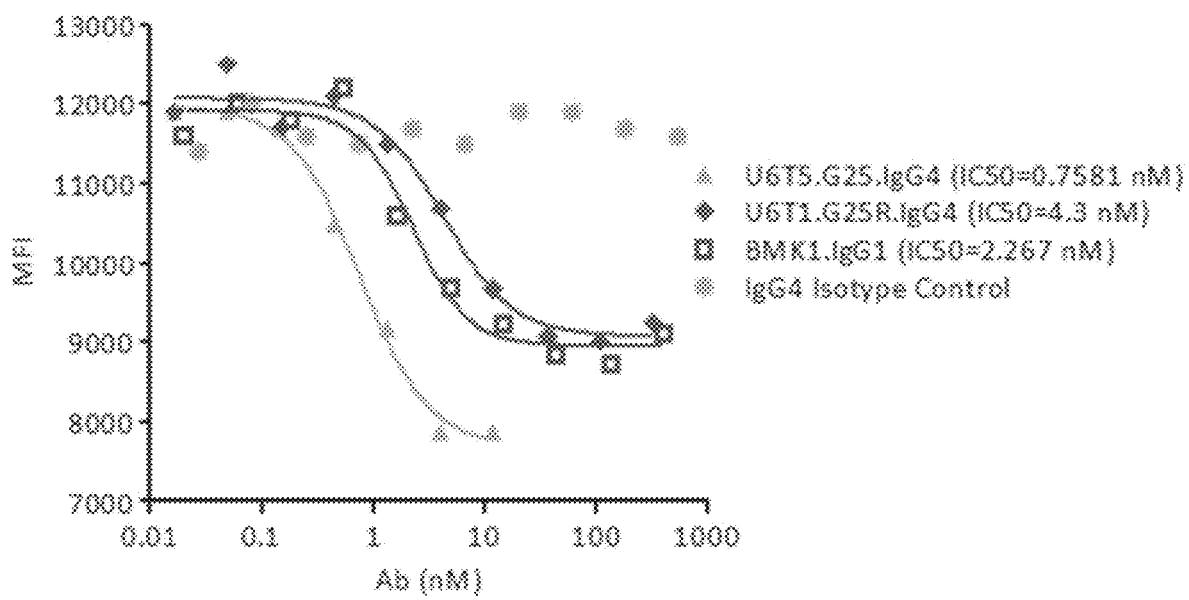

The bindings of all the U6T5 molecules, the previously identified U6T1.G25R molecule, as well as the benchmark antibody were all conducted and compared. Results were listed in FIGS. 29A-29B. The PD-1 side kept the original binding behaviors as observed before, because no PD-1 antibodies were replaced in any of the formats. However, for the CTLA-4 side, all the U6T5 constructs (even G19 and G19R formats) exhibited obvious superior bindings than U6T1.G25R as well as the benchmark molecule. U6T5.G25 was the strongest one among all the new proteins, which has 1.6× improved $EC_{50}$ and >3× improved top values compared to the benchmark antibody. This molecule was further characterized in the ELISA dual binding assay and FACS competition assays. FIG. 30 proved the effective dual bindings of the molecules to both targets simultaneously. The data in FIGS. 31A-31B confirmed that U6T5.G25 had significantly improved competition capability with CD80 to CTLA-4. This proved that WuXiBody formats were sufficiently flexible to handle different parental antibodies. The superior part of a parental antibody could be well conserved and reflected when the molecule is plugged into WuXiBody formats.

The thermal stability of the molecules that covered all the four symmetric formats was characterised. Most of the molecules showed the melting temperature around 60° C. (shown in Table 37), which is consistent with the asymmetric format shown above.

TABLE 37

Melting Temperatures of Representative Antibodies in WuXiBody Formats

| Protein Name | Isotype | pI | Buffer | Concentration (mg/ml) | $T_h1$ (° C.) | $T_h2$ (° C.) |
|---|---|---|---|---|---|---|
| T1U6.G19.IgG4 | IgG4, kappa, lamda | 5.92 | PBS | 1.3 | 60.8 | 69.9 |
| U6T1.G19.IgG4 | IgG4, kappa, lamda | 5.92 | PBS | 0.9 | 59.1 | 72.8 |
| U6T1.G25R.IgG4 | IgG4, kappa, lamda | 6.06 | PBS | 1.385 | 60.8 | 73.9 |
| U6T5.G19.IgG4 | IgG4, kappa, lamda | 5.93 | PBS | 0.6 | 56.2 | 74.1 |
| U6T5.G19R.IgG4 | IgG4, kappa, lamda | 5.87 | PBS | 1.2 | 63.4 | — |
| U6T5.G25.IgG4 | IgG4, kappa, lamda | 5.93 | PBS | 0.7 | 63.4 | — |
| U6T5.G25R.uIgG4 | IgG4, kappa, lamda | 5.99 | PBS | 0.5 | 57.2 | 74.1 |

Example 16: Light-Heavy Switched Chimeric Fab

Figure 32:
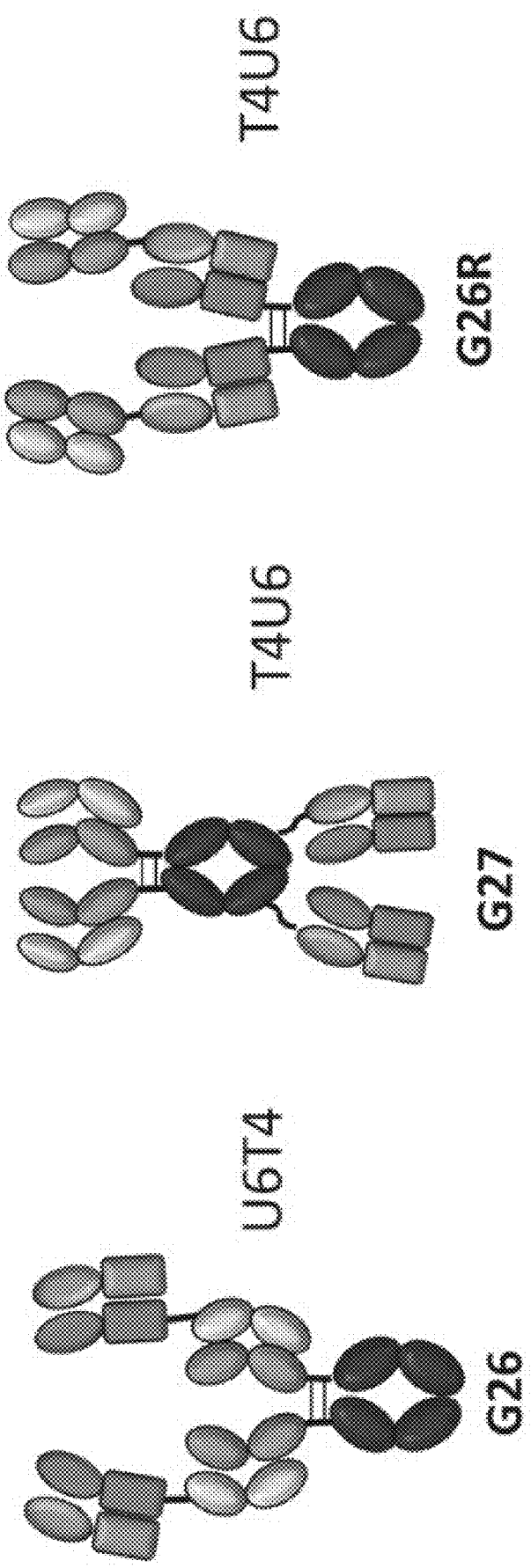
FIG. 32 shows schematic description of three symmetric formats G26, G27, and G26R with light-heavy switched chimeric Fab-like domains.
Figure 33A:
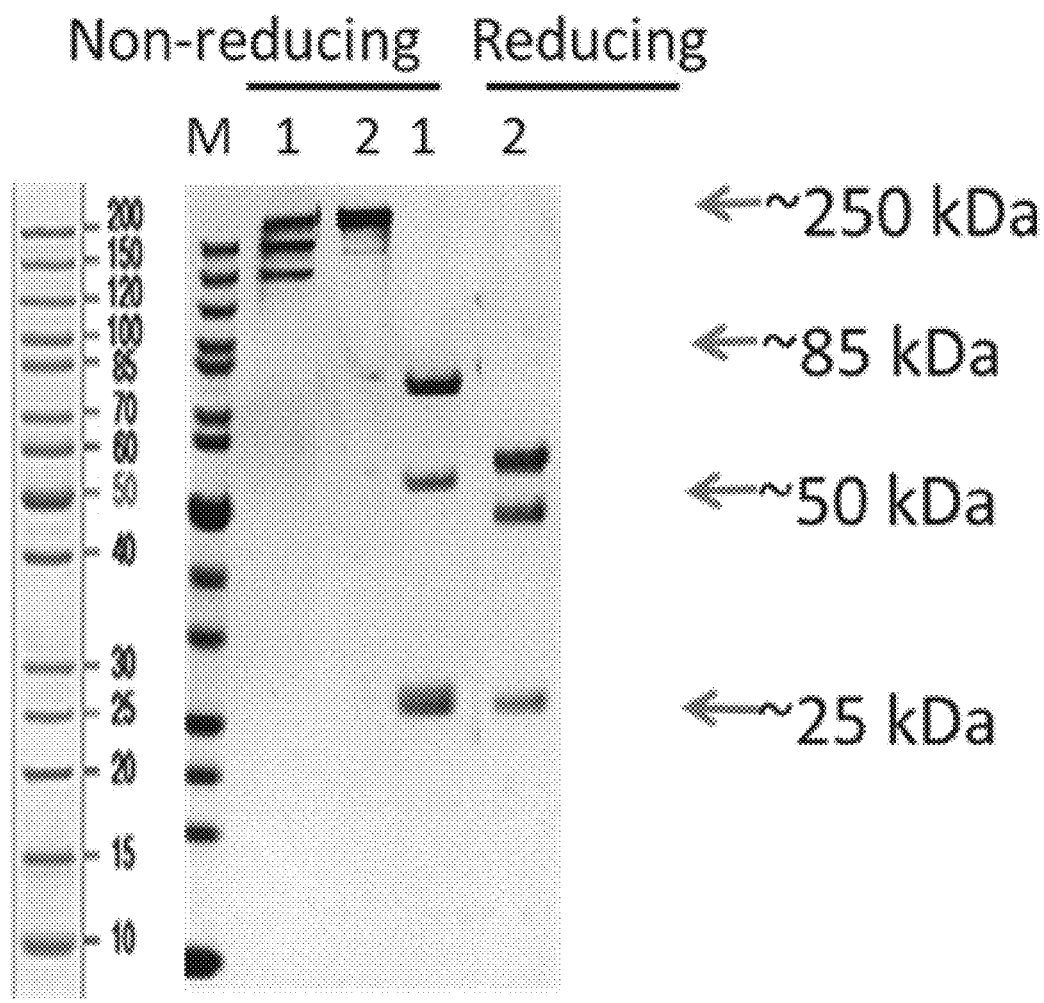

In total, 111 potential WuXiBody based formats were successfully designed. Besides E17, F16, G19, G19R, G25 and G25R shown above, a few formats with light-heavy crossed TCR-chimeric Fab were also designed. These were named G26, G26R, and G27, shown in FIG. 32. This time, antibody pair U6 and T4 was used, where T4 was an anti-CTLA-4 antibody WBP3162-1.146.19-z12. The T4U6 pair was developed on format G27 and G26R. FIGS. 33A-33B showed the purified protein characterized by SDS-PAGE and SEC-HPLC. Although both proteins were expressed, T4U6.G27.IgG4 had low purity, but T4U6.G26R.IgG4 had correct molecular weight and high purity. The binding capability of the later molecule was characterized in FACS binding. FIGS. 34A-34B showed that the PD-1 binding, since located in the bottom side, was affected, while the CTLA binding side showed full recovery as it was put at the top side of the format.

The U6T4 pair was tried on format G26. The expression and purification steps both worked well as shown in FIGS. 35A-35B. The ELISA and FACS binding were both conducted and the data were shown in FIGS. 36A-36D. These data proved that the light-heavy crossed chimeric Fab can still work well. The melting temperature of this molecule is around 63.4, as shown in Table 38.

TABLE 38

Melting Temperature of U6T4.G26.IgG4

| Protein Name | Isotype | pI | Buffer | Concentration (mg/ml) | $T_h1$ (° C.) | $T_h2$ (° C.) |
|---|---|---|---|---|---|---|
| U6T4.G26.IgG4 | IgG4, kappa, lamda | 5.93 | PBS | 0.8 | 63.4 | — |

Example 17: Bispecific Anti-CD13×CD19 WuXiBody

Background
Target Biology

The human CD19 is a type I transmembrane protein belonging to the immunoglobulin superfamily (Carter et al., Curr Dir Autoimmun, 2004, 7:4-32). It is expressed on most B cells, but not detected on plasma cells, stem cells, or on normal myeloid lineage (Tedder, Nat Rev Rheumatol, 2009, 5(10):572-577). CD19 is critically involved in establishing intrinsic B cell signaling thresholds through modulating both B cell receptor (BCR)-dependent and independent signaling (Wang et al., Experimental Hematology & Oncology, 2012, 1:36). CD19 has broader expression than CD20. The pattern of CD19 expression is maintained in B-cell malignancies, covering all subtypes of B-cell lymphoma, from indolent to aggressive forms, as well as B-cell chronic lymphocytic leukemia and non-T acute lymphoblastic leukemia, and allows the targeting of tumor indications of early B cells, such as acute lymphoblastic leukemia (ALL), which cannot be targeted by Rituximab. Several CD19 monoclonal antibody have been explored for lymphoma therapy (U.S. Patent Application Publication No. 20140072587 A1, U.S. Pat. No. 8,242,252 B2, and U.S. Pat. No. 8,097,703 B2).

The CD3 T-cell co-receptor is a protein complex composed of four distinct chains, a CD3gamma chain, a CD3delta chain, and two CD3epsilon chains. The four chains associate with a molecule known as T-cell receptor (TCR) and the zeta-chain to generate activation signal in T lymphocytes. The TCR, zetachain, and CD3 molecules compose the TCR complex, in which TCR as a subunit recognizes and binds to antigen, and CD3 as a subunit transfers and conveys the antigen stimulation to signaling pathway, and ultimately regulates T-cell activity. The CD3 protein is present in virtually all T cells. The CD3-TCR complex modulates T cell functions in both innate and adoptive immune response, as well as cellular and humoral immune functions. These include eliminating pathogenic organisms and controlling tumor growth by broad range of cytotoxic effects. Mouse monoclonal antibodies specific for human CD3, such as OKT3 (Kung et al., Science, 1979, 206: 347-9), were the first generation CD3 antibodies developed for treatment. Although OKT3 has strong immunosuppressive potency, its clinical use was hampered by serious side effects linked to its immunogenic and mitogenic potentials (Chatenoud, Nature Reviews, 2003, 3:123-132). OKT3 induced an anti-globulin response, promoting its own rapid clearance and neutralization (Chatenoud et al., Eur. J. Immunol., 1982, 137:830-8). In addition, OKT3 induced T-cell proliferation and cytokine production in vitro, and led to a large scale release of cytokine in vivo (Hirsch et al., J. Immunol, 1989, 142: 737-43). Such serious side effects limited the more widespread use of OKT3 in transplantation as well as the extension of its use to other clinical fields such as autoimmunity (Id.).

A bispecific antibody targeting CD3 and CD19 can bind to T cells and B cells simultaneously. Once the bispecific antibody binds to a CD3-positive T cell and a CD19-positive B cell, a cytolytic synapse is formed. Cytotoxicity is then induced by the release of perforin and granzymes from granules in the cytotoxic T cell, the latter inducing apoptosis and lysis of the malignant B cell.

The activity of blinatumomab has been proved to be independent of antigen presentation by class I MHC and TCR recognition. Therefore, it can circumvent a variety of tumor-mediated immune escape mechanisms, such as impairment of antigen presentation machinery and activation of negative costimulatory signals in the tumor microenvironment.

Unmet Medical Needs

The treatment of acute lymphoblastic leukemia (ALL) in adults remains challenging and novel therapies are needed. With the current therapies, the response rates range from 30 to 50% depending on the duration of the initial remission, age and cytogenetics. The overall response rates for a subset of non-Hodgkin lymphoma (NHL) are now greater than 90% under regimens employing the first generation of anti-CD20 antibodies. However, several NHL subtypes are not as responsive to these therapies, and the majority of patients with responsive NHL eventually relapse after the standard combined immunotherapy/chemotherapy regimen. Thus, both new first-line therapies and new salvage regimens are required for these unmet needs.

Materials and Methods

Generation of Cynomolgus Monkey CD19 Expressing Cell Line

The gene of full length human or cynomolgus monkey CD19 was cloned into pcDNA3.3 vector. Each expression vector was then transfected into CHO-K1 cells respectively using Lipofectamine 2000. The cells were cultured in F12-K with 10% FBS. Blasticidin was added 24-48 hours after transfection. After two to three passages of selection, the cells were enriched by PE conjugated anti-CD19 antibody and Anti-PE Microbeads (Miltenyi-013-048-801). Stable single cell clones were isolated by limiting dilution and screened by FACS using anti-CD19 antibody.

Target-Expressing Tumor Lines

Raji and Jurkat cells were from ATCC. Ramos cell was from ECACC. All the tumor cells were cultured in RPMI1640/10% FBS.

Construction of WuXiBody W3438-T3U4.E17-1.uIgG4.SP and W3438-T3U4.F16-1.uIgG4.SP The VL, VH, Ck, CH1 genes were amplified by PCR from existing in-house DNA templates. CAlpha and CBeta genes were synthesized by Genewiz Inc. Anti CD19 Native or Anti CD3 chimeric light chain genes were inserted into a linearized vector containing a CMV promoter and a kappa signal peptide. The DNA fragments of Anti CD3 VH-CBeta were inserted into a linearized vector containing human IgG4S228P constant region CH2-CH3 with a knob mutation. The DNA fragments of Anti CD19 VH-CH1 were inserted into a linearized vector containing human IgG4S228P constant region CH2-CH3 with a hole mutation. The vector contains a CMV promoter and a human antibody heavy chain signal peptide.

Expression and Purification of W3438-T3U4.E17-1.uIgG4.SP and W3438-T3U4.F16-1.uIgG4.SP Heavy chain and light chain expression plasmids were co-transfected into Expi293 cells using Expi293 expression system kit (ThermoFisher-A14635) according to the manufacturer's instructions. Five days after transfection, the supernatants were collected and the protein was purified using Protein A column (GE Healthcare-17543802) and further size exclusion column (GE Healthcare-17104301). Antibody concentration was measured by Nano Drop. The purity of proteins was evaluated by SDS-PAGE and HPLC-SEC.

Target Binding by FACS

The binding of bi-specific antibodies to CD3- and CD19-expressing cells was evaluated using Jurkat and Ramos, respectively. A non-relevant antibody was used as an isotype control. Cells were spread in 96-well plates (Corning-3799) at a density of $10^5$ cells/well and washed with PBS/1% BSA. The antibodies were serial-diluted and incubated with cells at 4° C. for 1 hr. PE-conjugated goat anti-human IgG Fc Antibody (Jackson-109-115-098) was used for detection. After washing and resuspending, cells were analyzed by flow cytometry (Canto II, BD Biosciences). Data were analyzed using FlowJo software. Four-parameter non-linear regression analysis was used to calculate $EC_{50}$ values using Prism GraphPad Software.

Binding to Cynomolgus CD3

The binding of the CD3×CD19 bispecific antibody to Cynomolgus CD3 were tested by protein binding ELISA. 96-well high protein binding ELISA plates (Nunc MaxiSorp, ThermoFisher, Thermo-442404) were coated overnight at 4° C. with 100 ul of 1 µg/ml Cynomolgus CD3 epsilon protein (Acro, # CDE-C5226) in Carbonate-bicarbonate buffer (20 mM Na2CO3, 180 mM NaHCO3, PH9.2). All wells were washed one time with 300 µL per well of PBS/0.5‰ Tween-20 (v/v). The wells were then blocked for one hour at room temperature with 200 µL per well of PBS/2% BSA (BOVOGEN, # BSAS) and washed three times with 300 µL per well of PBS/0.5‰ Tween-20 (v/v). For the primary antibody binding, CD3×CD19 bispecific antibody serially diluted in PBS/2% BSA were added to the relevant wells and incubated at room temperature for two hours. Plates were washed three times like before prior to the addition of 100 ul of 100 ng/ml secondary antibody Goat-anti-human IgG Fc-HRP (Bethyl, # A80-304P). Plates were incubated at room temperature for one hour, followed by six washes as described above. For the binding detection, 100 ul Tetramethylbenzidine (TMB) Substrate solution (Sigma-860336) was added to all wells for 10 minutes at room temperature in the dark before stopping the reaction with 100 ul 2M HCl. The extent of bispecific antibody binding to Cynomolgus CD3 was determined by measuring the OD450 absorbance using the SpectraMax® M5e microplate reader. Wherever appropriate, binding EC50 values were obtained by the four-parameter non-linear regression analysis using GraphPad Prism5 software.

Binding to Cynomoglus CD19

Binding of the CD3×CD19 bispecific antibody to Cynomoglus CD19 target protein expressed on CHOK1 cells was determined by flow cytometry analysis. In brief, cynomoglus CD19 over-expressed stable cell line (WBP701.CHOK1.cPro1.C9, WuXi Biologics) were harvested with trypsin and diluted to $1\times10^6$ cells/ml in 1% BSA/1×PBS. $1\times10^5$ cells/well (100 ul) were added to each well of a 96-well U-plate (Corning, #3799) and centrifuged at 1500 rpm (Eppendorf, #5810R) for 5 minutes before removing the supernatant. Antibodies serially diluted in 1% BSA/1×PBS were added at 100 ul/well to the pelleted cells and incubated at 4° C. for 1 hour. A non-related hIgG4 antibody was used as an isotype control. Cells were washed two times with 180 ul/well of 1% BSA/1×PBS by centrifugation at 1500 rpm for 5 minutes at 4° C. Pelleted cells were resuspended in 100 ul/well Fluorescence-labeled anti-human IgG Fc antibody (Jackson, #109-115-098) 1:150 diluted in 1% BSA/1×PBS for 30 minutes at 4° C. in the dark. Cells were then washed two times as described above. After the final wash, cells were resuspended in 80 ul 1% BSA/1×PBS and fluorescence values were measured with a FACS Canto II cytometer (BD Biosciences). The amount of cell surface bound anti-CD19&CD3 bispecific antibody was assessed by measuring the mean fluorescence (MFI). The FACS raw data were analyzed by FlowJo software, wells containing no antibody or secondary antibody only were used to establish background fluorescence. Binding EC50 values were obtained by the four-parameter non-linear regression analysis using GraphPad Prism 5 software.

Affinity by FACS

Binding affinity to CD3 and CD19 was determined by flow cytometry using Jurkat and Ramos cells, respectively. The cells were transferred in to 96-well U-bottom plates (BD) at a density of $5\times10^4$ cells/well. Antibodies to be tested were 1:2-fold serially diluted in 1% 1×PBS/1% BSA and incubated with cells at 4° C. for 1 hr. Then, the plates were centrifuged at 1500 rpm for 4 mins and the supernatant discarded. The secondary antibody, Alexa647 conjugated goat anti-human IgG Fc (Jackson, Cat #109-605-098) or FITC conjugated goat anti-His (Bethyl, Cat # A190-113F) was added to re-suspended cells and incubated at 4° C. in the dark for 30 min. The cells were washed once and re-suspended in 100 µL 1×PBS/1% BSA. Fluorescence intensity was measured by flow cytometry (BD Canto II) and analyzed by FlowJo. Fluorescence intensity was converted to bound molecules/cell based on the quantitative beads (Quantum™ MESF Kits, Bangs Laboratories). $K_D$ was calculated by Graphpad Prism5.

Dual-Binding on Target Cells

The ability of bispecific antibodies to bridge CD3 T cells and CD19 B cells was tested by FACS. Jurkat cells and Raji cells were pre-labeled separately with 20 nM CellTrace Far Red (Invitrogen-C34564) and 50 nM Calcein-AM (Invitrogen-C3099) at 37° C. for 30 min, at a density of $1*10^6$ cells/ml. The pre-labeled cell pellets were washed twice with PBS/1% BSA, then mixed 1:1 to a final density of $1*10^6$ cells/ml. The cell mixture was centrifuged and resuspended with 10 nM antibody followed by 1 hr incubation. The cell mixture was analyzed by flow cytometry immediately after incubation. Bridging percentage was calculated as the percentage of events that are simultaneously labeled Far-Red and Calcein.

Cytotoxicity Assay

Peripheral Blood Mononuclear Cells (PBMCs) were freshly isolated by Ficoll-Paque PLUS (GE Healthcare-17-1440-03) density centrifugation from heparinized venous blood. Then obtained PBMCs were passed through EasySep (Stemcell-19053) columns for the enrichment of CD8+ T cells, which were used as effector cells. The efficacy of the antibodies to mediate tumor cell lysis by CD8+ T cells was determined by flow cytometry. In the cyotoxicity assay, Raji CD19 B cells as target cells were pre-labeled with 20 nM CellTrace Far Red (Invitrogen-C34564) at 37° C. for 30 min followed by washing the cell pellets twice with phenol-free RPMI 1640 (Invitrogen-11835030) supplemented with 1% FBS. Far Red-stained Raji (20000 cells per well) was incubated in 96-well round-bottom plate (Corning-3799) with isolated CD8+ T cells (effector/target cells ratio 5:1) and serial-diluted antibodies at 37° C. for 4 h. Following incubation, 3 µM Propidium Iodide (PI, Invitrogen-P3566) was mixed thoroughly for identifying dead cells. After 15 min, cells were analyzed by flow cytometry using a FACSCanto II cytometer. The Ab-mediated cytotoxicity can be defined as the PI-positive target cells percentage in Far Red-positive target cells. EC50 of the cytotoxicity was determined using Prism.

T Cell Activation Assay

Secreted Cytokine TNFα and IFNγ

Whether T cells were activated was reflected by the quantity of TNFα and IFNγ secreted to supernatant. The isolation procedure of CD4 and CD8 positive T cells was described in Section "T Cell Activation (Intracellular Cytokine TNFα & IFNγ Staining)". The mixture of Raji human B cells ($2*10^4$ cells/well), CD4 or CD8 T cells ($1*10^5$ cells/well), and antibodies was co-incubated at 37° C. for 24 h. The supernatant was collected followed by centrifuging the reaction mixture at 1500 rpm for 5 min. The quantity of TNFα and IFNγ in the supernatant was determined by Human TNF ELISA Set (R&D-DY210) and Human IFNγ ELISA Set (Capture Ab: Thermo Fisher-M700A, Detection Ab: Thermo Fisher-M701B, Standard substance: PERO-TECH-300-02) respectively.

The procedure of sandwich ELISA was as follows. 96-well high protein binding ELISA plates (ThermoFisher-442404) were coated overnight at 4° C. or room temperature with 50 μl/well capture antibody in Carbonate-bicarbonate buffer (20 mM Na2CO3, 180 mM NaHCO3, pH 9.2) according to the kit specifications. All wells were washed three times with 300 μl per well of PBS/0.5% Tween-20 (v/v) and all the following wash steps in the assay were performed the same. The wells were then blocked for one hour with PBS/2% BSA (BovoGen Biologicals-BSAS) for TNFα and 100% casein (Pierce-37528) for IFNγ then washed three times, followed by binding of collected supernatant above or standard substance (50 μl/well) for 1 hour at room temperature and three washes afterwards. For the detection antibody binding, corresponding antibodies diluted in PBS/2% BSA for TNFα and 50% casein for IFNγ were added to the relevant wells and incubated at room temperature for two hours. Plates were washed three times prior to the addition of 50 μl of secondary antibody SA-HRP. Plates were incubated at room temperature for one hour, followed by six washes as described above. For the binding detection, 50 μl Tetramethylbenzidine (TMB) Substrate solution (Sigma-860336) was added to all wells for 10 minutes before stopping the reaction with 50 μl 2M HCl. The quantity of TNFα and IFNγ was determined by measuring the OD450 absorbance using the SpectraMax® M5e microplate reader.

T Cell Activation Assay-Surface Marker CD25 and CD69 Expression

Whether T cells were activated was reflected by staining signals of surface receptors CD25 and CD69. The isolation procedure of CD4 and CD8 positive T cells was described in Section "T Cell Activation (Intracellular Cytokine TNFα & IFNγ Staining)". The mixture of Raji human B cells ($2*10^4$ cells/well), CD4 or CD8 T cells ($1*10^5$ cells/well), and antibodies was co-incubated at 37° C. for 24 h. Following washing once with 1% BSA, the cell pellets were resuspended with staining buffer containing FITC Mouse Anti-human CD4 (BD-550628) or PerCpCy5.5 Mouse Anti-human CD8 (BD-560662), PE Mouse Anti-human CD69 (BD-560968) and APC Mouse Anti-human CD25 (BD-555434), followed by a 30 min incubation at 4° C. After washing cells twice, the percentage of PE and APC positive cells in FITC or PerCpCy5.5 positive cells was determined by flow cytometry.

Thermal Stability (DSF)

Melting temperature (Tm) of antibodies was investigated using QuantStudio™ 7 Flex Real-Time PCR system (Applied Biosystems). 19 μL of antibody solution was mixed with 1 μL of 62.5×SYPRO Orange solution (Invitrogen) and transferred to a 96 well plate (Biosystems). The plate was heated from 26° C. to 95° C. at a rate of 0.9° C./min, and the resulting fluorescence data was collected. The negative derivatives of the fluorescence changes with respect to different temperatures were calculated, and the maximal value was defined as melting temperature Tm. If a protein had multiple unfolding transitions, the first two Tm were reported, named as Tm1 and Tm2. Data collection and Tm calculation were conducted automatically by the operation software.

Serum Stability

Human blood was freshly collected from selected donors to polystyrene tubes without anticoagulant. Following 30 min's standing at room temperature, the human blood was centrifuged at 4000 rpm for 10 min to collect the serum layer. The centrifugation step was repeated until the serum was clarifying. Antibodies were mixed under detection with collected serum at the ratio of 1:9, and aliquots were drawn at 37° C. for the indicated times: 0 day, 1 day, 4 days, 7 days and 14 days. The samples were quick-frozen at different time points in liquid nitrogen and stored at −80° C. until use. The samples were analyzed by FACS to assess the binding ability on Jurkat CD3 T cells and Ramos CD19 B cells by comparison with that of corresponding antibodies without serum treatment.

Fcγ Receptor Binding Affinity by SPR

Antibody binding affinity to FcγRs was detected using Biacore T200 (or Biacore 8K). Each receptor was captured on an anti-his antibody immobilized CM5 sensor chip (GE). Antibodies at different concentrations were injected over the sensor chip at a flow rate of 30 uL/min for an association phase of 60 s, followed by 60 s dissociation. The chip was then regenerated by 10 mM glycine (pH 1.5) after each binding cycle.

The sensorgrams of blank surface and buffer channel were subtracted from the test sensorgrams. The experimental data was fitted by 1:1 model using Langmiur analysis (for FcγRI) or steady state model (for other receptors). A molecular weight of 150 KDa was used to calculate the molar concentration of antibodies.

C1q Binding by ELISA

ELISA Plates (Nunc) were coated with antibody samples at 3 μg/mL overnight at 4° C. After blocking and washing, C1q was gradient diluted starting from 600 μg/mL and incubated at room temperature for 2 hr. The plates were then washed and subsequently incubated with sheep anti-human C1q Ab-HRP for 1 hr. After washing, TMB substrate was added and the interaction was stopped by 2 M HCl. The absorbance at 450 nm was read using a microplate reader (Molecular Device).

FcRn Binding Affinity by SPR

Antibody binding affinity to FcRn was detected using Biacore T200 (or Biacore 8K). Each antibody was immobilized on CM5 sensor chip (GE). FcRn at different concentrations in running buffer (50 mM Na2HPO4/NaH2PO4, 150 mM NaCl, 0.05% Tween20, pH 6.0) were injected over the sensor chip at a flow rate of 30 uL/min for an association phase of 60 s, followed by 60 s dissociation. The chip was then regenerated by 1×PBS (pH 7.4) after each binding cycle.

The sensorgrams of blank surface and buffer channel were subtracted from the test sensorgrams. The experimental data was fitted by steady state model. Molecular weight of 45 KDa was used to calculate the molar concentration of FcRn.

Efficacy Study in Murine Raji/PBMC Model

The Raji tumor cells (ATCC® CCL-86™) were maintained in vitro as a monolayer culture in RPMI-1640 medium supplemented with 10% fetal bovine serum, 100 U/ml penicillin and 100 μg/ml streptomycin at 37° C. in an atmosphere of 5% $CO_2$ in air. The tumor cells were routinely subcultured twice weekly. The cells growing in an exponential growth phase were harvested and counted for tumor inoculation.

Human PBMCs were isolated from heparin whole blood by using Ficoll-Paque Plus per manufacturer's instructions.

Each mouse was co-inoculated subcutaneously at the right flank with Raji tumor cells mixed with Matrigel and fresh PBMC in 0.2 ml of PBS on D0. Antibodies injection was conducted from D3 (i.v. BIW×4 times).

Testing Article Preparation

| Compounds | Package | Preparation | Conc. mg/ml |
|---|---|---|---|
| Isotype control | 9.38 mg/ml | 0.031 ml solution + 1.908 ml PBS | 1.5 |
| W3438-T3U4.E17-1.uIgG4.SP | 2.6 mg/ml | B: 0.138 ml solution + 2.254 ml PBS | 1.5 |
| W3438-T3U4.E17-1.uIgG4.SP | | B1: 0.450 ml B + 1.800 ml PBS | 0.3 |
| W3438-T3U4.E17-1.uIgG4.SP | | B2: 0.450 ml B1 + 1.800 ml PBS | 0.06 |

Tumor Measurements and Endpoints

The major endpoint was to see if the tumor growth could be delayed or mice could be cured. Tumor size was measured twice weekly in two dimensions using a caliper, and the volume was expressed in $mm^3$ using the formula: $V=0.5 \, a \times b^2$ where a and b are the long and short diameters of the tumor, respectively. The T/C value (in percent) is an indication of antitumor effectiveness.

TGI was calculated for each group using the formula: TGI (%)=[1−(Ti−T0)/(Vi−V0)]×100; Ti is the average tumor volume of a treatment group on a given day, T0 is the average tumor volume of the treatment group on the day of treatment start, Vi is the average tumor volume of the vehicle control group on the same day with Ti, and V0 is the average tumor volume of the vehicle group on the day of treatment start.

Cynomolgus Monkey PK, Toxicity and Immunogenicity

One male and one female cynomolgus monkeys were were administered with WBP3438 at 1 mg/kg once by intravenous bolus administration. The formulations were formulated in 20 mM NaAc-HAc, 7.0% (w/w) Sucrose, 0.02% (w/v) PS80, pH5.0. PK blood samples were collected at pre-dose (Day-1), 0.25 h, 0.5 h, 1 h, 4 h, 8 h, 24 h, Day 3, Day 7, Day 14, Day 21 and Day 28. Antidrug antibody (ADA) samples were collected at 3 d, 14 d (312 h) and 28 d (480 h).

Serum concentrations of WBP3438 and ADA in serum samples were determined by ELISA. The serum concentration of WBP3438 in monkeys was subjected to a non-compartmental pharmacokinetic analysis by using the Phoenix WinNonlin software (version 6.3, Pharsight, Mountain View, CA). The linear/log trapezoidal rule was applied in obtaining the PK parameters.

Cage-side observations for general health and appearance, especially skin irritation was observed. Whole blood sample analysis for hematology (CBC) and serum analysis for chemistry detection were determined by hematology analyzer (ADVIA2120) and chemistry (HITACHI 7180), respectively.

Results

Generation of Cynomolgus CD19 Expressing Cell Line

The expression of cynomolgus CD19 expressing cell line WBP701.CHO-K1.cpro1.FL.C9 was detected using anti-CD19 antibody by flow cytometry. WBP701.CHO-K1.cpro1.FL.C9 showed high expression of monkey CD19 (FIG. 37).

WuXiBody Generation and Optimization

Figure 1:
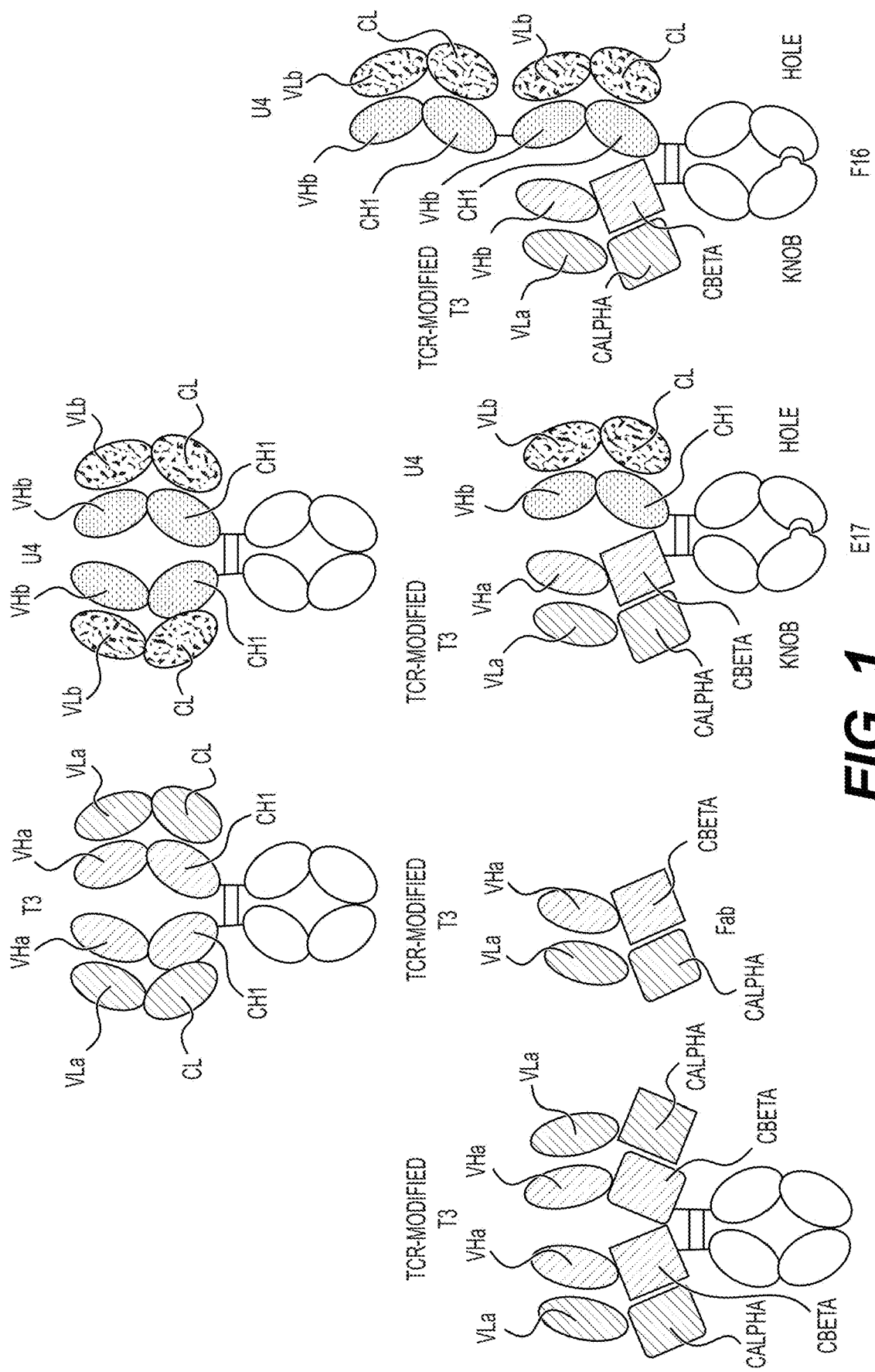
FIG. 1 presents schematic representations of studied antibody formats. Both anti-CD3 antibody T3 and anti-CD19 antibody U4 were developed. The constant region (CL and CH1) of T3 was replaced by the constant domains of TCR to design unique light-heavy chain interface that is orthogonal to regular antibody. The TCR-modified T3 and native U4 in conjunction with "knobs-into-holes" mutations in Fc domain were used to design bispecific antibody formats E17 and F16.

FIG. 1 presents schematic representations of studied antibodies and formats. Both anti-CD3 antibody T3 and anti-CD19 antibody U4 were developed. The constant region (CL and CH1) of T3 was replaced by the constant domain of TCR to design unique light-heavy chain interface that is orthogonal to regular antibody. The TCR-modified T3 and native U4 in conjunction with "knobs-into-holes" mutations in Fc domain were used to design bispecific antibody format E17 and F16.

Variable heavy chain and light chain sequences of anti-CD3 and anti-CD19 binding moieties from W3438-T3U4.E17-1.uIgG4.SP and W3438-T3U4.F16-1.uIgG4.SP are provided below:

| | | |
|---|---|---|
| W3438-T3U4.E17-1.uIgG4.SPVH & W3438-T3U4.F16-1.uIgG4.SP anti-CD3 antibody | DNA sequence (SEQ ID NO: 353) | CAGGTGCAGCTTGTGCAGTCTGGGGCAGAAGTG AAGAAGCCTGGGTCTAGTGTCAAGGTGTCATGC AAGGCTAGCGGGTTCGCCTTTACTGACTACTACA TCCACTGGGTGCGGCAGGCTCCCGGACAAGGGT TGGAGTGGATGGGATGGATCTCCCCAGGCAATG TCAACACAAAGTACAACGAGAACTTCAAAGGC CGCGTCACCATTACCGCCGACAAGAGCACCTCC ACAGCCTACATGGAGCTGTCCAGCCTCAGAAGC GAGGACACTGCCGTCTACTACTGTGCCAGGGAT GGGTACTCCCTGTATTACTTTGATTACTGGGGCC AGGGCACACTGGTGACAGTGAGCTCC |
| | Amino acid sequence (SEQ ID NO: 352) | QVQLVQSGAEVKKPGSSVKVSCKASGFAFTDYYI HWVRQAPGQGLEWMGWISPGNVNTKYNENFKG RVTITADKSTSTAYMELSSLRSEDTAVYYCARDG YSLYYFDYWGQGTLVTVSS |
| anti-CD3 antibody VL | DNA sequence (SEQ ID NO: 355) | GATATCGTGATGACCCAGAGCCCAGACTCCCTTG CTGTCTCCCTCGGCGAAAGAGCAACCATCAACT GCAAGAGCTCCCAAAGCCTGCTGAACTCCAGG ACCAGGAAGAATTACCTGGCCTGGTATCAGCAG AAGCCCGGCCAGCCTCCTAAGCTGCTCATCTACT GGGCCTCCACCCGGCAGTCTGGGGTGCCCGATC GGTTTAGTGGATCTGGGAGCGGGACAGACTTCA CATTGACAATTAGCTCACTGCAGGCCGAGGACG TGGCCGTCTACTACTGTACTCAGAGCCACACTCT CCGCACATTCGGCGGAGGGACTAAAGTGGAGAT TAAG |
| | Amino acid sequence (SEQ ID NO: 354) | DIVMTQSPDSLAVSLGERATINCKSSQSLLNSRTR KNYLAWYQQKPGQPPKLLIYWASTRQSGVPDRFS GSGSGTDFTLTISSLQAEDVAVYYCTQSHTLRTFG GGTKVEIK |

-continued

| | | |
|---|---|---|
| anti-CD19 antibody VH | DNA sequence (SEQ ID NO: 368) | CAAATGCAGCTCGTCCAGTCTGGACCTGAAGTG AAGAAGCCCGGGACATCCGTCAAGGTCTCATGT AAGGCTAGCGGGTACGCATTCACTTCCTACAAC ATGTACTGGGTGCGCCAGGCCAGAGGACAGAG GTTGGAGTGGATCGGCTACATCGACCCATACAA CGCCGATACTACCTACAATCAGAAGTTTAAAGG GCGGGTGACCATTACCCGGGATATGTCCACCTCC ACCGCCTACATGGAGCTGAGCAGCCTGAGGAGC GAGGACACAGCCGTGTACTACTGCCTGACAACA GCCTATGCCATGGACTATTGGGGCCAGGGCACA CTTGTGACTGTGAGCAGT |
| | Amino acid sequence (SEQ ID NO: 367) | QMQLVQSGPEVKKPGTSVKVSCKAS<u>GYAFTSYN MY</u>WVRQARGQRLEWIG<u>YIDPYNADTTYNQKFKG</u> RVTITRDMSTSTAYMELSSLRSEDTAVYYCLT<u>TAYA MDY</u>WGQGTLVTVSS |
| anti-CD19 antibody VL | DNA sequence (SEQ ID NO: 370) | GACATCCAGCTCACCCAATCCCCTTCTTTCCTCT CCGCAAGTGTCGGAGATAGGGTGACTATCACCT GCTCAGCTTCTTCAACCGTGAACTACATGCATTG GTACCAGCAGAAGCCCGGGAAAGCCCCAAAGC TGCTGATCTACAGCACCTCCAATCTGGCCAGTGG AGTGCCAAGCCGGTTTAGCGGGAGCGGCTCCGG CACTGAATTCACTTTGACAATTAGCAGCCTTCAG CCTGAGGACTTTGCCACATATTACTGTCACCAGT GGTCCAGCTACCCCTACACATTCGGGCAGGGCA CAAAGCTGGAGATTAAG |
| | Amino acid sequence (SEQ ID NO: 369) | DIQLTQSPSFLSASVGDRVTITC<u>SASSTVNYMH</u>WY QQKPGKAPKLLIY<u>STSNLAS</u>GVPSRFSGSGSGTEF TLTISSLQPEDFATYYC<u>HQWSSYPYT</u>FGQGTKLEIK |

Full-length W3438-T3U4.E17-1.uIgG4.SP and W3438-T3U4.F16-1.uIgG4.SP sequences are provided below:

| Antibody | Chain | Sequences |
|---|---|---|
| W3438-T3U4.E17-1.uIgG4.SP | T3-LC (SEQ ID NO: 12) | DIVMTQSPDSLAVSLGERATINCKSSQSLLNSRTRKNYLAWYQQKPGQP PKLLIYWASTRQSGVPDRFSGSGSGTDFTLTISSLQAEDVAVYYCTQSHT LRTFGGGTKVEIKPDIQNPDPAVYQLRDSKSSDKSVCLFTDFDSQTQVS QSKDSDVYITDKCVLDMRSMDFKSNSAVAWSQKSDFACANAFQNSIIP EDTFFPSPESS |
| | T3-HC (SEQ ID NO: 25) | QVQLVQSGAEVKKPGSSVKVSCKASGFAFTDYYIHWVRQAPGQGLEW MGWISPGNVNTKYNENFKGRVTITADKSTSTAYMELSSLRSEDTAVYY CARDGYSLYYFDYWGQGTLVTVLEDLKNVFPPEVAVFEPSEAEISHTQ KATLVCLATGFYPDHVELSWWVNGKEVHSGVCTDPQPLKEQPALQDS RYALSSRLRVSATFWQNPRNHFRCQVQFYGLSENDEWTQDRAKPVTQI VSAEAWGRYGPPCPPCPAPEFLGGPSVFLFPPKPKDTLMISRTPEVTCVV VDVSQEDPEVQFNWYVDGVEVHNAKTKPREEQFNSTYRVVSVLTVLH QDWLNGKEYKCKVSNKGLPSSIEKTISKAKGQPREPQVYTLPPCQEEM TKNQVSLWCLVKGFYPSDIAVEWESNGQPENNYKTTPPVLDSDGSFFL YSRLTVDKSRWQEGNVFSCSVMHEALHNHYTQKSLSLSLGK |
| | U4-LC (SEQ ID NO: 23) | DIQLTQSPSFLSASVGDRVTITCSASSTVNYMHWYQQKPGKAPKLLIYS TSNLASGVPSRFSGSGSGTEFTLTISSLQPEDFATYYCHQWSSYPYTFGQ GTKLEIKRTVAAPSVFIFPPSDEQLKSGTASVVCLLNNFYPREAKVQWK VDNALQSGNSQESVTEQDSKDSTYSLSSTLTLSKADYEKHKVYACEVT HQGLSSPVTKSFNRGEC |
| | U4-HC (SEQ ID NO: 26) | QMQLVQSGPEVKKPGTSVKVSCKASGYAFTSYNMYWVRQARGQRLE WIGYIDPYNGDTTYNQKFKGRVTITRDMSTSTAYMELSSLRSEDTAVYY CLTTAYAMDYWGQGTLVTVSSASTKGPSVFPLAPCSRSTSESTAALGCL VKDYFPEPVTVSWNSGALTSGVHTFPAVLQSSGLYSLSSVVTVPSSSLG TKTYTCNVDRKPSNTKVDKRVESKYGPPCPPCPAPEFLGGPSVFLFPPK PKDTLMISRTPEVTCVVVDVSQEDPEVQFNWYVDGVEVHNAKTKPRE EQFNSTYRVVSVLTVLHQDWLNGKEYKCKVSNKGLPSSIEKTISKAKG QPREPQVCTLPPSQEEMTKNQVSLSCAVKGFYPSDIAVEWESNGQPEN NYKTTPPVLDSDGSFFLVSRLTVDKSRWQEGNVFSCSVMHEALHNHYT QKSLSLSLGK |

| Antibody | Chain | Sequences |
|---|---|---|
| W3438-T3U4.F16-1.uIgG4.SP | T3-LC (SEQ ID NO: 12) | DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPDIQNPDPAVYQLRDSKSSDKSVCLFTDFDSQTQVSQSKDSDVYITDKCVLDMRSMDFKSNSAVAWSQKSDFACANAFQNSIIPEDTFFPSPESS |
|  | T3-HC (SEQ ID NO: 25) | QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSRLTVDKSRWQEGNVFSCSVMHEALHNHYTQKSLSLSLGK |
|  | U4-LC (SEQ ID NO: 23) | DIQLTQSPSFLSASVGDRVTITCSASSTVNYMHWYQQKPGKAPKLLIYSTSNLASGVPSRFSGSGSGTEFTLTISSLQPEDFATYYCHQWSSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
|  | U4-HC (SEQ ID NO: 27) | QMQLVQSGPEVKKPGTSVKVSCKASGYAFTSYNMYWVRQARGQRLEWIGYIDPYNGDTTYNQKFKGRVTITRDMSTSTAYMELSSLRSEDTAVYYCLTTAYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVGGGGSGGGGSQMQLVQSGPEVKKPGTSVKVSCKASGYAFTSYNMYWVRQARGQRLEWIGYIDPYNGDTTYNQKFKGRVTITRDMSTSTAYMELSSLRSEDTAVYYCLTTAYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSRLTVDKSRWQEGNVFSCSVMHEALHNHYTQKSLSLSLGK |

Production of W3438-T3U4.F16-1.uIgG4.SP

The expression titer of antibody W3438-T3U4.F16-1.uIgG4.SP is higher than 90 mg/L through transient expression. After 2-step purification, the purity of W3438-T3U4.F16-1.uIgG4.SP reaches 97.5% (SEC-HPLC, FIG. 39). W3438-T3U4.F16-1.uIgG4.SP migrates with the apparent molecular mass of 75 kDa, 55 kDa and 25 kDa on SDS-PAGE under reducing conditions, corresponding to the two heavy chains and two light chains. The two light chains may overlap due to similar molecular weights. The antibody migrates with the apparent molecular mass of 200 kDa under non-reducing condition indicating the intact bispecific molecule (FIG. 38).

Production of W3438-T3U4.E17-1.uIgG4.SP

The expression titer of antibody W3438-T3U4.E17-1.uIgG4.SP is higher than 100 mg/L through transient expression. After 2-step purification, the purity of W3438-T3U4.E17-1.uIgG4.SP reaches 95% (SEC-HPLC, FIG. 41). W3438-T3U4.E17-1.uIgG4.SP migrates with the apparent molecular mass of 54 kDa, 56 kDa and 25 kDa on SDS-PAGE under reducing conditions, corresponding to the two heavy chains and two light chains. The two light chains may overlap due to similar molecular weights. The antibody migrates with the apparent molecular mass of 150 kDa under non-reducing condition indicating the intact bispecific molecule (FIG. 40).

Target Binding

The binding of W3438-T3U4.E17-1.uIgG4.SP to CD19 and CD3 was tested on Ramos and Jurkat cells by flow cytometry (FIGS. 42A-42B). The antibody W3438-T3U4.E17-1.uIgG4.SP showed strong binding activities to Ramos and Jurkat cells, with $EC_{50}$ values of 15.6 nM and 47 nM respectively.

The binding of W3438-T3U4.F16-1.uIgG4.SP to CD19 and CD3 was tested on Ramos and Jurkat cells by flow cytometry (FIGS. 43A-43B). The antibody W3438-T3U4.F16-1.uIgG4.SP showed strong binding activities to Ramos and Jurkat cells, with $EC_{50}$ values of 1.8 nM and 19.3 nM respectively.

Cross Species Binding

The binding of W3438-T3U4.E17-1.uIgG4.SP to cynomolgus CD19 was tested on WBP701.CHO-K1.cpro1.FL.C9 cell (CD19-expressing cell) by flow cytometry (FIG. 44). The binding $EC_{50}$ was 26 nM. The binding of W3438-T3U4.E17-1.uIgG4.SP to cynomolgus CD3 was tested using W331-cynoPro1.ECD.His (Cynomolgus CD3 epsilon protein) by ELISA (FIG. 45). The binding $EC_{50}$ was 0.04 nM.

Affinity to Target Cells

The binding affinity of W3438-T3U4.E17-1.uIgG4.SP to human CD19 and CD3 was tested on Ramos and Jurkat cells by flow cytometry. The bound IgG/free IgG versus bound IgG was plotted in FIGS. 46A and 46B. The fitted $K_D$ values of binding to CD19 and CD3 were 23 nM and 9.0 nM, respectively.

Dual Binding on Target Cells

The activity of W3438-T3U4.E17-1.uIgG4.SP to bridge CD3 T cell and CD19 B cell was tested using pre-labeled Jurkat and Raji cells by flow cytometry (FIGS. 47A-47B). Q2 shows the population of bridged Jurkat and Raji cells. Compared with the negative control, roughly 18% of cells were bridged through bispecific antibody W3438-T3U4.E17-1.uIgG4.SP.

Cytotoxicity Assay

The cytotoxic activity of W3438-T3U4.E17-1.uIgG4.SP was evaluated using CD8+ T cell and raji cell. W3438-

T3U4.E17-1.uIgG4.SP induced rapid and efficacious cell lysis after 4 hours incubation (FIG. 48A) with an $EC_{50}$ value of 15 nM. The maximum cell killing percentage was 90%.

The cytotoxic activity of W3438-T3U4.F16-1.uIgG4.SP was evaluated using CD8+ T cell and raji cell. W3438-T3U4.F16-1.uIgG4.SP induced rapid and efficacious cell lysis after 4 hours incubation (FIG. 48B) with an $EC_{50}$ value of 3.2 nM. The maximum cell killing percentage was 90%.

Target Specific T Cell Activation

W3438-T3U4.E17-1.uIgG4.SP was investigated in assays that indicate T cell activation through activation markers CD69 and CD25 in the presence or absence of CD19+ target cells. The results demonstrated that W3438-T3U4.E17-1.uIgG4.SP induces the expression of the T cell activation markers CD25 and CD69 in a dose-dependent manner only in the presence of CD19+ target cells (FIGS. 49A-49D). When the B cell is absent, no expression of CD25 and CD69 was observed in both CD4+ and CD8+ T cell subsets.

W3438-T3U4.E17-1.uIgG4.SP was also investigated in T cell activation assays of cytokine release in the presence or absence of CD19+ target cells. The results demonstrated that W3438-T3U4.E17-1.uIgG4.SP induces IFN-γ and TNF-α release in a dose-dependent manner only in the presence of CD19+ target cells (FIGS. 50A-50D). When the B cell is absent, no IFN-γ and TNF-α was detected in both CD4+ and CD8+ T cell subsets.

Thermal Stability

The thermal stability of W3438-T3U4.E17-1.uIgG4.SP was investigated using Real-Time PCR. $T_m1$ and $T_m2$ of W3438-T3U4.E17-1.uIgG4.SP are 60.2° C. and 72.7° C.

Serum Stability

W3438-T3U4.E17-1.uIgG4.SP was incubated in serum at 37° C. for 14 days. The binding activity of the antibody incubated for 0, 1, 4, 7 and 14 days was detected by flow cytometry. The results showed that the binding activity of W3438-T3U4.E17-1.uIgG4.SP to both CD3 and CD19 cells was unchanged after incubating in human serum for 14 days (FIGS. 51A-51B).

Fcγ Receptor Binding

The binding activity of W3438-T3U4.E17-1.uIgG4.SP to FcγRI, FcγRIIa (H167), FcγRIIa (R167), FcγRIIb, FcγRIIIa (F176), FcγRIIIa (V176) and FcγRIIIb were investigated by SPR. The affinities were summarized in Table 39. W3438-T3U4.E17-1.uIgG4.SP showed typical human IgG4 binding affinity to all the Fcγ receptors.

TABLE 39

Affinity of W3438-T3U4.E17-1.uIgG4.SP to Fc Receptor by SPR

| Fc receptor | $K_D$ (M) |
| --- | --- |
| FcγRI | 9.79E−09 |
| FcγRIIa (H167) | 2.05E−05 |
| FcγRIIa (R167) | 1.58E−05 |
| FcγRIIb | 2.41E−05 |
| FcγRIIIa (F176) | 2.93E−05 |
| FcγRIIIa (V176) | 1.40E−05 |
| FcγRIIIb | >4.10E−05 |

The binding activity of antibodies to C1Q was tested by ELISA. W3438-T3U4.E17-1.uIgG4.SP showed no binding signal in ELISA (FIG. 52), and the control human IgG1 antibody showed normal binding signal.

FcRn Binding

The binding of W3438-T3U4.E17-1.uIgG4.SP to FcRn was tested by SPR at pH 6.0. The affinity was fitted as 2.58 μM which is a typical affinity of human IgG4 to FcRn.

Efficacy Study in the PBMC/Raji Xenograft Model

In this study, anti-tumor efficacy of W3438-T3U4.E17-1.uIgG4.SP in the admixed PBMC humanized model bearing Raji cell in NOG mice was investigated. The tumor growth curve is shown in FIG. 53.

At D14, the mean tumor size of the isotype control treatment group reached 342 $mm^3$. The treatment with 1.5 mg/kg and 0.5 mg/kg of W3438-T3U4.E17-1.uIgG4.SP produced a significant antitumor activity. The mean tumor size was respectively 78 $mm^3$ (T/C=23.0%, TGI=93.9%, p=0.016) and 75 $mm^3$ (T/C=22.0%, TGI=95.3%, p=0.014), and the tumor of one animal in high dosing level group was eradicated. W3438-T3U4.E17-1.uIgG4.SP at very low dose (0.06 mg/kg) did not show any antitumor activity.

Pharmacokinetics of WuXiBody in Cynomolgus Monkey

The concentration of W3438-T3U4.E17-1.uIgG4.SP in cynomolgus serum was tested by ELISA (FIG. 54). The calculated PK parameters were listed in Table 40. The half life of W3438-T3U4.E17-1.uIgG4.SP for once single IV injection at 1 mg/kg was 152 hours. W3438-T3U4.E17-1.uIgG4.SP showed much longer half life in monkey than blinatumomab which has a very short half-life (1.5-2.6) hours in chimpanzees (European Medicines Agency assessment report EMA/CHMP/469312/2015).

TABLE 40

Cynomolgus PK of W3438-T3U4.E17-1.uIgG4.SP

| PK parameter | W3438-T3U4.E17-1.uIgG4.SP |
| --- | --- |
| $C_0$ (μg/mL) | 60.4 |
| $T_{1/2}$ (h) | 152 |
| $Vd_{ss}$ (L/kg) | 0.0513 |
| Cl (mL/min/kg) | 0.00462 |
| $AUC_{0-last}$ (h*μg/mL) | 3552 |
| $AUC_{0-inf}$ (h*μg/mL) | 3708 |
| $MRT_{0-last}$ (h) | 157 |
| $MRT_{0-inf}$ (h) | 187 |

Toxicity

All monkeys tolerated the drug well during the entire course of the study. No adverse effects were observed during the in-life phase of the study. There was no obvious change in food consumption and weight. The parameters for Hematology and Clinical Chemistry, including AST, ALT, WBC, HGB and HCT were generally within the reference range.

Immunogenicity

The immunogenicity test results of W3438-T3U4.E17-1.uIgG4.SP are shown in FIGS. 55A-55B. The titers of anti-drug antibody (ADA) against W3438-T3U4.E17-1.uIgG4.SP in monkey serum of 3, 14 and 28 days post dose showed no significant difference from predose. Therefore, the single IV injection of W3438-T3U4.E17-1.uIgG4.SP at 1 mg/kg appeared not immunogenic in monkeys.

Example 18: Bispecific Anti-CTLA-4×PD-1 WuXiBody

Background

Cancer immunotherapy has become a hot research area for treating cancer. Cytotoxic T-lymphocyte-associated protein 4 (CTLA-4) is one of the validated targets of immune checkpoints. After T cell activation, CTLA-4 quickly expresses on those T cells, generally within one hour of antigen engagement with TCR. CTLA-4 can inhibit T cell signaling through competition with CD28, which mediates a well characterized T cell co-stimulatory signal. CD28 binding to its ligands CD80 (B7-1) and CD86 (B7-2) on antigen presenting cells leads to T cell proliferation by inducing production of interleukin-2 and anti-apoptotic factors. Due to much higher affinity binding of CTLA-4 to CD80 and CD86 than that of CD28, CTLA-4 can out-compete with CD28 binding on CD80 and CD86, leading to suppression of T cell activation. In addition to induced expression on activated T cells, CTLA-4 is constitutively expressed on the surface of regulatory T cells (Treg), suggesting that CTLA-4 may be required for contact-mediated suppression and associated with Treg production of immunosuppressive cytokines such as transforming growth factor beta and interleukin-10.

CTLA-4 blockade can induce tumor regression, as demonstrated in a number of preclinical and clinical studies. Two antibodies against CTLA-4 are in clinical development. Ipilimumab (MDX-010, BMS-734016), a fully human anti-CTLA-4 monoclonal antibody of IgG1-kappa isotype, is an immunomodulatory agent that has been approved as monotherapy for treatment of advanced melanoma. The proposed mechanism of action for Ipilimumab is interference in the interaction of CTLA-4, which is expressed on a subset of activated T cells, with CD80/CD86 molecules on professional antigen presenting cells. This results in T-cell potentiation due to blockade of the inhibitory modulation of T-cell activation promoted by the CTLA-4 and CD80/CD86 interaction. The resulting T-cell activation, proliferation and lymphocyte infiltration into tumors, leads to tumor cell death. The commercial dosage form is a 5 mg/ml concentrate for solution for infusion. Ipilimumab is also under clinical investigation for other tumor types, including prostate and lung cancers. The second anti-CTLA-4 antibody in clinical development, Tremelimumab, was evaluated as monotherapy in melanoma and malignant mesothelioma.

Programmed Death-1 (PD-1, CD279) is a member of CD28 family expressed on activated T cells and other immune cells. Engagement of PD-1 inhibits function in these immune cells. PD-1 has two known ligands, PD-L1 (B7-H1, CD274) and PD-L2 (B7-DC, CD273), both belong to B7 family. PD-L1 expression is inducible on a variety of cell types in lymphoid and peripheral tissues, whereas PD-L2 is more restricted to myeloid cells including dendritic cells. The major role of PD-1 pathway is to reduce inflammatory immune response in tissues and organs.

Immunotherapy with the combination of monoclonal antibodies (mAbs) that block CTLA-4 (Ipilimumab) and PD-1 (Nivolumab) has shown clinical benefit beyond that observed with either mAb alone. Bispecific anti-CTLA-4× PD-1 WuXiBody were developed to induce antitumor immunity through simultaneous blockade of both of the checkpoint molecules.

Materials and Methods

General Materials

General research materials and their sources are listed in Table below.

| Materials | Vendor | Cat. |
|---|---|---|
| Expi293F ™ Cells | Thermo Fisher | Cat. A14527 |
| ExpiFectamine293 transfection kit | Thermo Fisher | Cat. A14524 |
| Expi293F ™ expression medium | Thermo Fisher | Cat. A1435101 |
| Lipofectamine ™ 2000 Transfection Reagent | Thermo Fisher | Cat. 11668019 |
| FreeStyle ™ 293-F Cells | Thermo Fisher | Cat. R79007 |
| FreeStyle ™ 293 Expression Medium | Thermo Fisher | Cat. 12338002 |
| CHO-S Cells | Thermo Fisher | Cat. A1155701 |
| FreeStyle ™ CHO Expression Medium | GIBCO | Cat. 12651014 |
| Fetal bovine serum (FBS) | Corning | Cat. 35-076-CV |
| Opti-MEM | Thermo Fisher | Cat. 31985070 |
| Ni column | GE healthcare | Cat. 17-5247-01 |
| Protein A column | GE healthcare | Cat. 17-5438-02 |
| Superdex200 prep grade | GE Healthcare | Cat. 17-1043-01 |
| HPLC-SEC | TOSOH | Cat. 0008541 |
| NuPAGE4%-12% Bis-Tris Gel | Thermo Fisher | Cat. NP0322BOX |
| Human CTLA-4: W316-hPro1.ECD.His | Sino Biological | Cat. 11159-H08H |
| Cynomolgus CTLA-4: W316-cpro1.ECD.his | Sino Biological | Cat. 90213-C08H |
| Human PD-1: W305-hPro1.ECD.His | In house | |
| Cynomolgus PD-1: W305-cynoPro1.ECD.His | R&D | Cat.R&D-8509-PD-050 |
| Coating 96-well plates for ELISA | Nunc MaxiSorp, ThermoFisher | |
| U-bottom 96-well plates for FACS | Corning-COSTAR | 3799 |
| Human PD-1+ cell line: W305-CHO-S.hPro1.C6 | In house | |
| Cynomolgus PD-1+ cells: W305-293F.cPro1.FL.Pool | In house | |
| Human CTLA-4+ cell line: W316-293F.hPro1.FL | In house | |
| Cynomolgus CTLA-4+ cell line W316-293F.cPro1.FL.Pool | In house | |
| Human CD80+ cell line: W316-CHO-K1.hPro1L1.B9B11 | In house | |
| Human CD86+ cell line W316-CHO-K1.hPro1L2.A4A7 | In house | |
| Human PD-1: W305-hPro1.ECD.mFc | In house | |
| Human PD-1: W305-hPro1.ECD.hFc | In house | |
| Human PD-1: W305-hPro1.ECD.His | In house | |
| Cynomolgus PD-1: W305-cPro1.ECD.His | In house | |
| CynoPD-1.hFc protein | SinoBiological | 90311C02H |
| Human CTLA-4: W316-hPro1.ECD.mFc | In house | |
| Human CTLA-4: W316-hPro1.ECD.hFc | In house | |
| Human CTLA-4: W316-hPro1.ECD.His | In house | |
| Cynomolgus CTLA-4: W316-cPro1.ECD.His | In house | |
| Human PDL1: W315-hPro1.ECD.mFc | In house | |
| CynoPD-L1.hFc-Biotin | In house | |
| Biotin-labeled W316.hPro1.ECD.hFc | In house | |
| Human CD80: W316-hPro1L1.ECD.His | In house | |
| WBP316-BMK1 (Ipilimumab) | In house | |
| WBP305 BMK1 (nivolumab) | In house | |
| WBP324-BMK1.IgG1.KDL | In house | |
| Isotype control: WBP332-1.80.12.xAb.hIgG4 | In house | |
| HRP-labeled goat anti-human IgG Fc | Bethyl Laboratories | A80-304P |
| HRP-labeled mouse anti-Human IgG Fc (CH2) | Thermo | MA5-16859 |
| HRP-labeled goat anti-mouse IgG Fc | Bethyl Laboratories | A90-231P |
| HRP-labeled Streptavidin | Lifetechnologies | SNN1004 |
| Biotin-labeled anti-His mAb | GenScript | A00613 |
| FITC-labeled goat anti-human IgG | Jackson | 109-095-008 |
| PE-labeled goat anti-human IgG | Jackson | 109-115-098 |

| Materials | Vendor | Cat. |
|---|---|---|
| FITC-labeled goat anti-Mouse IgG | Abcam | 98716 |
| PE-labeled Streptavidin | BD | 554061 |
| Human Ficoll-Paque | Stemcell | 07861 |
| Monocyte enrichment kit | Miltenyi | Biotec-130-050-201 |
| CD4+ T cell enrichment kit | Stemcell | 19052 |
| CD4+CD25+ T cell enrichment kit | Miltenyi | 130-093-631 |
| Recombinant human GM-CSF | R&D | 215-GM |
| Recombinant human IL-2 | SLPHARM | |
| Recombinant human IL-4; anti-IL-2 Ab | R&D | AG1815401; MAB602 |
| Recombinant human IFN-γ standard | Peprotech | 300-02 |
| Anti-IFN-γ antibodies | life technology | M700A; M7001B |
| H3-thymidine and MicroScint | Perkin Elmer | NET027001MC |
| Fetal bovine serum (FBS) | GIBCO | 10100147 |
| RPMI 1640 medium | GIBCO | 22400089 |
| DPBS | Corning | 21-031-CVR |
| DELFIA ® EuTDA Cytotoxicity Reagents | PerkinElmer | AD0116 |
| CellTiter-Glo Luminescent Cell Viability Assay Kit | Promega | G7573 |
| Calcein-AM | Corning-354216 | 354216 |
| Far red | Invitrogen | C34572 |

Generation of Soluble Antigens

DNA sequences encoding the extracellular domain sequence of human PD-1 (Uniport No.: Q15116) were synthesized in Sangon Biotech (Shanghai, China), and then subcloned into modified pcDNA3.3 expression vectors with 6×his in C-terminal. Protein of human, cynomolgus and mouse CTLA-4 and mouse and cynomolgus PD-1 were purchased from Sino Biological.

Expi293 cells (Invitrogen-A14527) were transfected with the purified expression vector pcDNA3.3. Cells were cultured for 5 days and supernatant was collected for protein purification using Ni-NTA column (GE Healthcare, 175248). The obtained human PD-1 was QC'ed by SDS-PAGE and SEC, and then stored at −80° C.

Generation of Reference Antibodies

DNA sequence encoding the variable region of anti-CTLA-4 antibody (WBP316-BMK1), anti-PD-1 antibody (WBP305-BMK1) was synthesized in Sangon Biotech (Shanghai, China), and then subcloned into modified pcDNA3.4 expression vectors with constant region of human IgG1 or human IgG4 (S228P). Anti-PD-1 WBP3055-1.153.7.uIgG4k and WBP3055-1.103.11.uIgG4k antibodies were generated after immunizing rats with human PD-1 and mouse PD-1, and were converted to IgG4 (S228P) format. DNA sequence encoding a benchmark bispecific anti-CTLA-4×PD-1 antibody (WBP324-BMK1.IgG1.KDL) was synthesized.

The plasmids containing the VH and VL genes were co-transfected into Expi293 cells. Cells were cultured for 5 days and supernatant was collected for protein purification using Protein A column (GE Healthcare, 175438) or Protein G column (GE Healthcare, 170618). The obtained antibodies were tested by SDS-PAGE and SEC, and then stored at −80° C.

Generation of Target-Expressing Cell Lines

Using Lipofectamine 2000, CHO-S or 293F cells were transfected with the expression vectors containing the genes encoding full length human PD-1 or mouse PD-1. The cells were cultured in medium containing proper selection markers. The human PD-1 high expression stable cell line (WBP305.CHO-S.hPro1.C6) and mouse PD-1 high expression stable cell line (WBP305.293F.mPro1.B4) were obtained by limiting dilution.

Generation of Bispecific Anti-CTLA-4/PD-1 Bispecific Antibodies

Construction of W3248-U6T1.G25R-1.uIgG4.SP: DNA sequence encoding anti-PD-1 heavy chain variable region, constant region 1, anti-CTLA-4 heavy chain variable region, TCR beta constant region, and IgG4 (S228P) constant region 2 and 3, linked from 5' end to 3' end, were cloned into a modified pcDNA3.3 expression vector. DNA sequence encoding anti-CTLA-4 antibody light chain variable region on the 5' of TCR alpha constant region was cloned into another modified pcDNA3.3 expression vector. Anti-PD-1 light chain was cloned into the third modified pcDNA3.3 expression vector.

Construction of W3248-U6T5.G25-1.uIgG4.SP: DNA sequence encoding anti-PD-1 heavy chain variable region, constant region of TCR beta chain, anti-CTLA-4 heavy chain variable region and IgG4 (S228P) constant region, linked from 5' end to 3' end, were cloned into a modified pcDNA3.3 expression vector. DNA sequence encoding anti-PD-1 antibody light chain variable region on the 5' of TCR alpha constant region was cloned into another modified pcDNA3.3 expression vector. Anti-CTLA-4 light chain was cloned into the third modified pcDNA3.3 expression vector.

| LC1 | Amino acid sequence (SEQ ID NO: 412) | SYELTQPLSVSVALGQTARITCGGDNIGNKDVHWYQQKPGQ APVLVIYRDSNRPSGIPEGFSGSNSGNTATLTISRAQAGDEAD YYCQVWDSIWVFGGGTKLTVLGQPKAAPSVTLFPPSSEELQA NKATLVCLISDFYPGAVTVAWKADSSPVKAGVETTTPSKQSN NKYAASSYLSLTPEQWKSHKSYSCQVTHEGSTVEKTVAPTEC S |
| --- | --- | --- |
| LC2 | Amino acid sequence (SEQ ID NO: 413) | EIVLTQSPGTLSLSPGERATLSCRASQSVGSSYLAWYQQKPGQ APRLLIYGAFSRATGIPDRFSGSGSGTDFTLTISRLEPEDFAVY YCQQYGSSPWTFGQGTKVEIKPDIQNPDPAVYQLRDSKSSDK SVCLFTDFDSQTQVSQSKDSDVYITDKCVLDMRSMDFKSNSA VAWSQKSDFACANAFQNSIIPEDTFFPSPESS |

-continued

| | | |
|---|---|---|
| HC | Amino acid sequence (SEQ ID NO: 414) | EVQLLESGGGLVQPGGSLRLSCAASGFTFSSHAMSWVRQAPG KGLEWVSTITGGGSIYYADSVKGRFTISRDNSKNTLYLQMN SLRAEDTAVYYCAKNRAGEGYFDYWGQGTLVTVSSASTKGP SVFPLAPCSRSTSESTAALGCLVKDYFPEPVTVSWNSGALTSG VHTFPAVLQSSGLYSLSSVVTVPSSSLGTKTYTCNVDHKPSNT KVDKRVGGGGSGGGGSQVQLVESGGGVVQPGRSLRLSCAAS GFTFSSYTMHWVRQAPGKGLEWVTFISYDGNNKYYADSVKG RFTISRDNSKNTLYLQMNSLRAEDTAIYYCARTGWLGPFDYW GQGTLVTVLEDLKNVFPPEVAVFEPSEAEISHTQKATLVCLAT GFYPDHVELSWWVNGKEVHSGVCTDPQPLKEQPALQDSRYA LSSRLRVSATFWQNPRNHFRCQVQFYGLSENDEWTQDRAKP VTQIVSAEAWGRYGPPCPPCPAPEFLGGPSVFLFPPKPKDTLMI SRTPEVTCVVVDVSQEDPEVQFNWYVDGVEVHNAKTKPREE QFNSTYRVVSVLTVLHQDWLNGKEYKCKVSNKGLPSSIEKTI SKAKGQPREPQVYTLPPSQEEMTKNQVSLTCLVKGFYPSDIAV EWESNGQPENNYKTTPPVLDSDGSFFLYSRLTVDKSRWQEGN VFSCSVMHEALHNHYTQKSLSLSLG |

Relevant sequences of W3248-U6T1.G25R-1.uIgG4.SP are provided below:

| | | |
|---|---|---|
| LC1 | Amino acid sequence (SEQ ID NO: 415) | SYELTQPLSVSVALGQTARITCGGDNIGNKDVHWYQQKPGQA PVLVIYRDSNRPSGIPEGFSGSNSGNTATLTISRAQAGDEADYY CQVWDSIWVFGGGTKLTVLPDIQNPDPAVYQLRDSKSSDKSV CLFTDFDSQTQVSQSKDSDVYITDKCVLDMRSMDFKSNSAVA WSQKSDFACANAFQNSIIPEDTFFPSPESS |
| LC2 | Amino acid sequence (SEQ ID NO: 416) | EIVLTQSPDFQSVTPKEKVTITCSANSALSYMYWYQQKPDQSP KLWVHGTSNLASGVPSRFSGSGSGTDFTLTINSLEAEDAATYY CHHWSNTQWTFGGGTKVEIKRTVAAPSVFIFPPSDEQLKSGTA SVVCLLNNFYPREAKVQWKVDNALQSGNSQESVTEQDSKDS TYSLSSTLTLSKADYEKHKVYACEVTHQGLSSPVTKSFNRGEC |
| HC | Amino acid sequence (SEQ ID NO: 417) | EVQLLESGGGLVQPGGSLRLSCAASGFTFSSHAMSWVRQAPG KGLEWVSTITGGGSIYYADSVKGRFTISRDNSKNTLYLQMNS LRAEDTAVYYCAKNRAGEGYFDYWGQGTLVTVLEDLKNVFP PEVAVFEPSEAEISHTQKATLVCLATGFYPDHVELSWWVNGK EVHSGVCTDPQPLKEQPALQDSRYALSSRLRVSATFWQNPRN HFRCQVQFYGLSENDEWTQDRAKPVTQIVSAEAWGRGGGGS GGGGSQVQLVQSGAEVKKPGSSVKVSCKASGYTFTNYFMNW VRQAPGQGLEWMGRVDPEQGRADYAEKFKKRVTITADKSTS TAYMELSSLRSEDTAVYYCARRAMDNYGFAYWGQGTLVTVS SASTKGPSVFPLAPCSRSTSESTAALGCLVKDYFPEPVTVSWN SGALTSGVHTFPAVLQSSGLYSLSSVVTVPSSSLGTKTYTCNV DHKPSNTKVDKRVESKYGPPCPPCPAPEFLGGPSVFLFPPKPK DTLMISRTPEVTCVVVDVSQEDPEVQFNWYVDGVEVHNAKT KPREEQFNSTYRVVSVLTVLHQDWLNGKEYKCKVSNKGLPSS IEKTISKAKGQPREPQVYTLPPSQEEMTKNQVSLTCLVKGFYP SDIAVEWESNGQPENNYKTTPPVLDSDGSFFLYSRLTVDKSR WQEGNVFSCSVMHEALHNHYTQKSLSLSLG |

For both bispecific antibodies, one heavy chain expression vector and two light chain expression vectors were co-transfected into Expi293 cells (ThermoFisher-A14527) according to the manufacturer's instructions. Five days after transfection, the supernatants were harvested and purified using Protein A column (GE Healthcare-17543802) and further size-exclusion chromatography (GE Healthcare-17104301). Antibody concentration was measured by Nano Drop. The low endotoxin level was confirmed by using endotoxin detection kit (GenScript-L00350), and the endotoxin level of two bispecific antibodies was less than 10 EU/mg. The purity of proteins was evaluated by SDS-PAGE and HPLC-SEC.

In Vitro Charactrization

Differential Scanning Fluorimetry (DSF)

A DSF assay was performed using 7500 Fast Real-Time PCR system (Applied Biosystems). Briefly, 19 µL of bispecific antibody solution was mixed with 1 µL of 62.5×SYPRO Orange solution (TheromFisher-S6650) and added to a 96 well plate. The plate was heated from 26° C. to 95° C. at a rate of 2° C./min and the resulting fluorescence data was collected. The data was analyzed automatically by its operation software and Th was calculated by taking the maximal value of negative derivative of the resulting fluorescence data with respect to temperature. Ton can be roughly determined as the temperature of negative derivative plot beginning to decrease from a pre-transition baseline.

Human PD-1-Binding by FACS

Engineered human PD-1 expressing cells W305-CHO-S.hPro1.C6 were seeded at $1\times10^5$ cells/well in U-bottom 96-well plates (COSTAR 3799). Antibodies with 3.16-fold titration in 1% BSA DPBS from 200 nM to 0.002 nM were added to the cells. The plates were incubated at 4° C. for 1 hour. After wash, 100 µL 1:125 diluted PE-labeled goat anti-human antibody (Jackson 109-115-098) was added to each well and the plates were incubated at 4° C. for 1 hour. The binding of the antibodies onto the cells was tested by flow cytometry and the mean fluorescence intensity (MFI) was analyzed by FlowJo.

Cynomolgus PD-1-Binding by FACS

Engineered cynomolgus PD-1 expressing cells W305-293F.cynoPro1.FL.pool were seeded at $1\times10^5$ cells/well in U-bottom 96-well plates (COSTAR 3799). 4.0-fold titrated Abs with 1% BSA DPBS from 40 µg/ml to 0.0001526 µg/ml were added to the cells. Plates were incubated at 4° C. for 1 hour. After wash, 100 μL 1:150 diluted PE-labeled goat anti-human antibody (Jackson 109-115-098) was added to each well and the plates were incubated at 4° C. for 1 hour. The binding of the antibodies onto the cells was tested by flow cytometry and the mean fluorescence intensity (MFI) was analyzed by FlowJo.

Human CTLA-4-Binding by FACS

Engineered human CTLA-4 expressing cells W316-293F.hPro1.FL were seeded at 1×10$^5$ cells/well in U-bottom 96-well plates (COSTAR 3799). 3.16-fold titrated Abs with 1% BSA DPBS from 200 nM to 0.002 nM were added to the cells. Plates were incubated at 4° C. for 1 hour. After wash, 100 μL 1:150 diluted PE-labeled goat anti-human antibody (Jackson 109-115-098) was added to each well and the plates were incubated at 4° C. for 1 hour. The binding of the antibodies onto the cells was tested by flow cytometry and the mean fluorescence intensity (MFI) was analyzed by FlowJo.

Cynomolgus CTLA-4-Binding by FACS

Engineered human CTLA-4 expressing cells W316-293F.cynoPro1.F1.Pool were seeded at 1×10$^5$ cells/well in U-bottom 96-well plates (COSTAR 3799). 4-fold titrated Abs with 1% BSA DPBS from 40 μg/ml to 0.00004 μg/ml were added to the cells. Plates were incubated at 4° C. for 1 hour. After wash, 100 μL 1:150 diluted PE-labeled goat anti-human antibody (Jackson 109-115-098) was added to each well and the plates were incubated at 4° C. for 1 hour. The binding of the antibodies onto the cells was tested by flow cytometry and the mean fluorescence intensity (MFI) was analyzed by FlowJo.

hPD-1 and hCTLA-4 Dual Binding by ELISA

In order to test whether the bispecific antibodies could bind to both hPD-1 and hCTLA-4, an ELISA assay was developed as below. A 96-well ELISA plate (Nunc MaxiSorp, ThermoFisher) was coated overnight at 4° C. with 0.5 μg/ml antigen-1 (hPD-1-ECD, W305-hPro1.ECD.mFc) in carbonate-bicarbonate buffer. After a 1 hour blocking step with 2% (w/v) bovine serum albumin (Pierce) dissolved in PBS, serial dilutions of the different PD-1×CTLA-4 bispecific antibodies in PBS containing 2% BSA PBS were incubated on the plates for 1 hour at room temperature. Following the incubation, plates were washed three times with 300 μL per well of PBS containing 0.5% (v/v) Tween 20. 0.5 μg/ml antigen-2 (hCTLA-4-ECD, W316-hPro1.ECD.hFc.Biotin) was added to plates and the mixture was incubated for 1 hour. After washing the plates three times, Streptavidin-HRP (Lifetechnologies, # SNN1004) (1:20000 diluted) was added and incubated on the plates for 1 hour at room temperature. After washing six times with 300 μL per well of PBS containing 0.5% (v/v) Tween 20, 100 μL tetramethylbenzidine (TMB) substrate was added for the detection per well. The reaction was stopped after approximately 5 minutes through the addition of 100 μL per well of 2 M HCl. The absorbance of the wells was measured at 450 nm with a multiwall plate reader (SpectraMax® M5e).

hPD-1 and hCTLA-4 Dual Binding by FACS

In order to test whether the bispecific antibodies could bind to both hPD-1 and hCTLA-4, a FACS assay was developed as below. Engineered human PD-1 and CTLA-4 expressing cells W305-CHO-S.hPro1.C6 and W316-293F.hPro1.F1 were stained with Calcein-AM (Corning-354216) at 50 nM and Far red (Invitrogen-C34572) at 20 nM, respectively, for 20 mins at 37° C. After wash with 1% (w/v) bovine serum albumin (Pierce) dissolved in PBS twice, mixed hPD-1 (5E4) and hCTLA-4 (5E4) cells were seeded at 1×10$^5$ cells/well in U-bottom 96-well plates (COSTAR 3799). After removal of the supernatant, 3×serially diluted antibodies with 1% BSADPBS from 7.5 nM to 0.83 nM were added to the cells. The plates were incubated at 4° C. for 1.5 hour. The cells were tested by flow cytometry and the percentage of double positive cells was analyzed by FlowJo.

Human PD-1-Competitive FACS

In order to test whether the bispecific antibodies could block hPD-L1 binding to hPD-1 protein, a competitive FACS was conducted. Briefly, engineered human PD-1 expressing cells W305-CHO-S.hPro1.C6 (in house) were seeded at 1×10$^5$ cells/well in U-bottom 96-well plates (COSTAR 3799), 200 nM to 0.002 nM human PD-L1 coupled with 5 ug/ml human PD-L1 protein W315-hPro1.ECD.mFc were added to the cells. Plates were incubated at 4° C. for 1 hour. After wash, the binding of W315-hPro1.ECD.mFc to cell expressive human PD-1 was detected by FITC-labeled goat anti-mouse antibody (abcam 98716 1:125). The competition binding of antibodies to the cells was tested by flow cytometry and the mean fluorescence intensity (MFI) was analyzed by FlowJo.

Blockage of Human/Cynomolgus CTLA-4 Binding to Human CD80

ELISA was used to test whether the bispecific antibodies could block hCTLA-4 binding to hCD80 protein. Briefly, flat-bottom 96-well plates (Nunc MaxiSorp, ThermoFisher) were pre-coated with 0.5 μg/ml W316-hPro1.ECD.hFc overnight at 4° C. After 2% BSA blocking, 100 μL 3.16-fold titrated Abs from 400 nM to 0.04 nM Abs coupled with 0.5 μg/ml human CD80 protein W316-hPro1L1.ECD.His were pipetted into each well and incubated for 1 hour at ambient temperature. Following the incubation, plates are washed 3 times with 300 μL per well of PBS containing 0.5% (v/v) Tween 20. 100 μL 0.5 μg/ml Biotin-labeled anti-His mAb (GenScript-A00613) was added to plate pre well and incubation 1 hour. After washing for 6 times, the binding of W315-hPro1L1.ECD.His to WBP316-hPro1.ECD.hFc was detected by Streptavidin-HRP (Lifetechnologies, # SNN1004) (1:20000 diluted). The color was developed by dispensing 100 μL of TMB substrate, and then stopped by 100 μL of 2N HCl. The absorbance was read at 450 nm using a Microplate Spectrophotometer (SpectraMax® M5e).

Competitive FACS was used to test whether the antibodies could block human or cynomolgus CTLA-4 binding to hCD80 on cell surface. Briefly, human CD80-expressing CHO-K1 cells were added to each well of a 96-well plate (COSTAR 3799) at 1×10$^5$ per well and centrifuged at 1500 rpm for 4 minutes at 4° C. before removing the supernatant. Serial dilutions of test antibodies, positive and negative controls were mixed with biotinylated human CTLA-4.ECD.hFc. Due to different density of ligands on cell surface, 0.066-0.037 μg/mL of hCTLA-4.ECD.hFc-Biotin was used for human CD80-expressing cells. Then the mixtures of antibody and CTLA-4 were added to the cells and incubated for 1 hour at 4° C. The cells were washed two times with 200 μl FACS washing buffer (DPBS containing 1% BSA). Streptavidin PE (BD Pharmingen-554061) 1 to 600 diluted in FACS buffer was added to the cells and incubated at 4° C. for 1 hour. Additional washing steps were performed two times with 200 μL FACS washing buffer followed by centrifugation at 1500 rpm for 4 minutes at 4° C. Finally, the cells were resuspended in 100 μL FACS washing buffer and fluorescence values were measured by flow cytometry and analyzed by FlowJo.

Affinity to CTLA-4 and PD-1

SPR technology was used to measure the on-rate constant (ka) and off-rate constant (kd) of the antibodies to ECD of CTLA-4 or PD-1. The affinity constant (KD) was consequently determined.

Biacore T200, Series S Sensor Chip CM5, Amine Coupling Kit, and 10×HBS-EP were purchased from GE Healthcare. Goat anti-human IgG Fc antibody was purchased from Jackson ImmunoResearch Lab (catalog number 109-005-098). In immobilization step, the activation buffer was prepared by mixing 400 mM EDC and 100 mM NHS immediately prior to injection. The CM5 sensor chip was activated for 420 s with the activation buffer. 30 µg/mL of goat anti-human IgG Fcγ antibody in 10 mM NaAc (pH 4.5) was then injected to Fc1-Fc4 channels for 200 s at a flow rate of 5 µL/min. The chip was deactivated by 1 M ethanolamine-HCl (GE). Then the antibodies were captured on the chip. Briefly, 4 µg/mL antibodies in running buffer (HBS-EP+) was injected individually to Fc3 channel for 30 s at a flow rate of 10 µL/min. Eight different concentrations (20, 10, 5, 2.5, 1.25, 0.625, 0.3125 and 0.15625 nM) of analyte ECD of CTLA-4 or PD-1 and blank running buffer were injected orderly to Fc1-Fc4 channels at a flow rate of 30 µL/min for an association phase of 120 s, followed by 2400 s dissociation phase. Regeneration buffer (10 mM Glycine pH 1.5) was injected at 10 µL/min for 30 s following every dissociation phase.

Human Serum Stability

The antibodies were incubated in freshly isolated human serum at 37° C. On indicated time points, an aliquot of serum treated sample was removed from the incubator and snap frozen in liquid nitrogen, and then stored at −80° C. until ready for a dual-binding ELISA test. The frozen samples were quickly thawed immediately prior to the stability test. Briefly, plates were pre-coated with 0.5 µg/mL of hCTLA4.ECD.hFc (in house) at 4° C. overnight. After 1-hour blocking, the testing antibodies were added to the plates at various concentrations. The plates were incubated at ambient temperature for 1 hour. Following the incubation, the plates were washed three times with 300 µL per well of PBS containing 0.5% (v/v) Tween 20. Then 0.1 µg/ml hPD-1-ECD. Biotin was added to plates and the mixture was incubated for 1 hour. After washing the plates three times, Streptavidin-HRP (Lifetechnologies, # SNN1004) (1:20000 diluted) was added and incubated on the plates for 1 hour at room temperature. After washing six times with 300 µL per well of PBS containing 0.5% (v/v) Tween 20, 100 µL tetramethylbenzidine (TMB) substrate is added for the detection per well. The reaction was stopped after approximately 5 minutes by addition of 100 µL per well of 2 M HCl. The absorbance of the wells was measured at 450 nm with a multiwall plate reader (SpectraMax® M5e).

Results

Expression and Purification of Bispecific Antibodies

The purity of the bispecific antibodies was above 90%, analyzed by both SDS-PAGE (FIG. 56A) and SEC-HPLC (FIG. 56B).

DSF of WuXiBody

DSF was used to measure $T_m$ of WuXiBody. As shown in FIG. 57, W3248-U6T1.G25R-1.uIgG4.SP and WBP3248-U6T5.G25-1-uIgG4.SP have Th1 at 60.8 and 63.4° C., respectively.

Binding to Human and Cynomolgus PD-1

The bispecific antibodies could bind to human PD-1 (FIG. 58) and cynomolgus PD-1 (FIG. 59). The human PD-1-binding activity of W3248-U6T1.G25R-1.uIgG4.SP was slightly better than WBP3248-U6T5.G25-1-uIgG4.SP in FACS. W3248-U6T1.G25R-1.uIgG4.SP and WBP3248-U6T5.G25-1-uIgG4.SP have affinity to human PD-1 at 1.24 nM and 1.32 nM, respectively (FIG. 62).

Binding to Human and Cynomolgus CTLA-4

The purified bispecific antibodies bound to human CTLA-4, as tested in FACS (FIG. 60). The two bispecific antibodies also bound to cynomolgus CTLA-4 (FIG. 61). W3248-U6T1.G25R-1.uIgG4.SP and WBP3248-U6T5.G25-1-uIgG4.SP have affinity to human CTLA-4 at 0.0356 nM and 0.357 nM, respectively (FIG. 62).

Simultaneous Binding to CTLA-4 and PD-1

In order to test whether the bispecific antibodies can bind to both targets, ELISA and FACS were used. In the ELISA, human PD-1 was coated on the plate. After adding bispecific antibodies, biotinylated CTLA-4 was used to detect bound bispecific antibodies. As shown in FIG. 66, W3248-U6T1.G25R-1.uIgG4.SP and WBP3248-U6T5.G25-1-uIgG4.SP could bind to both PD-1 and CTLA-4 with EC50 at 0.1072 to 0.0710 nM, comparable with a bispecific reference antibody WBP324 BMK1 (EC50=0.0599 nM). In the FACS, both W3248-U6T1.G25R-1.uIgG4.SP and WBP3248-U6T5.G25-1-uIgG4.SP could simultaneously bind to PD-1+ and CTLA-4+ cells (FIG. 67).

Blocking Human or Cynomolgus CTLA-4 Binding to CD80 Binding

A competitive FACS was used to test the bispecific antibodies' blockage of CTLA-4 with its ligand CD80. W3248-U6T1.G25R-1.uIgG4.SP and WBP3248-U6T5.G25-1-uIgG4.SP blocked CTLA-4 binding to CD80 with $IC_{50}$ of 4.300 and 0.7581 nM (FIG. 64). Similarly, the bispecific antibodies could also block cynomolgus CTLA-4 binding to human CD80+ cells (FIG. 65).

Blocking PD-1 Binding to its Ligand

A competitive FACS was used to test the bispecific antibodies' blockage of PD-1 with its ligand PD-L1. W3248-U6T1.G25R-1.uIgG4.SP and WBP3248-U6T5.G25-1-uIgG4.SP blocked PD-1 binding to PD-L1 with $IC_{50}$ of 1.670 nM and 1.917 nM (FIG. 63).

Serum Stability

The two bispecific antibodies were incubated at 37° C. human serum for 14 days, and their dual binding to human CTLA-4 and PD-1 was measure in ELISA. As shown in FIGS. 68A and 68B, W3248-U6T1.G25R-1.uIgG4.SP and WBP3248-U6T5.G25-1-uIgG4.SP dual binding to the targets did not change over time, indicating that these two bispecific antibodies were stable in 37° C. human serum for at least 14 days.

While the disclosure has been particularly shown and described with reference to specific embodiments, it should be understood by those having skill in the art that various changes in form and detail may be made therein without departing from the spirit and scope of the present disclosure as disclosed herein.

SEQUENCE LISTING (411 sequences)

SEQ ID NO: 1 - protein, 207 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKRTVAAPDPAVYQLRDSKSSDKSVCLFTDFDSQTNVSQSKDSDVYITDKCVLDMRSMDFKSNSAVAWSNKSDFACANAFNNSIIPEDTFFPSPESS

SEQ ID NO: 2 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVSSASKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - protein, 207 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESS

SEQ ID NO: 4 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - protein, 461 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVSSASKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYPSNQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6 - protein, 461 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYPSNQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7 - protein, 457 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQSGRYALSSRLRVSATFWQNPRNHFRCQVQFYPSNQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8 - protein, 242 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKLEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEAWGRA

SEQ ID NO: 9 - protein, 442 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVSSASIQNPDPAVYQLRDSKSSDKSVCLFTDFDSQTNVSQSKDSDVYITDKCVLDMRSMDFKSNSAVAWSNKSDFACANAFNNSIIPEDTFFPSPESSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10 - protein, 442 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVSSPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - protein, 228 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKLEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYPSNQIVSAEAWGRA

SEQ ID NO: 12 - protein, 207 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPDIQNPDPAVYQLRDSKSSDKSVCLFTDFDSQTQVSQSKDSDVYITDKCVLDMRSMDFKSNSAVAWSQKSDFACANAFQNSIIPEDTFFPSPESS

SEQ ID NO: 13 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14 - protein, 207 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPDIQNPDPAVYQLRDSKSSDKSVCLFTDFDSQTAVSQSKDSDVYITDKCVLDMRSMDFKSNSAVAWSAKSDFACANAFANSIIPEDTFFPSPESS

SEQ ID NO: 15 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALADSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16 - protein, 207 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPDIQNPDPAVYQLRDSKSSDKSVCLFTDFDSQTQVSQSKDSDVYITDKCVLDMRSMDFKSNSAVAWSSKSDFACANAFKNSIIPEDTFFPSPESS

SEQ ID NO: 17 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALEDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 207 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPDIQNPDPAVYQLRDSKSSDKSVCLFTDFDSQTAVSQSKDSDVYITDKCVLDMRSMDFKSNSAVAWSSKSDFACANAFKNSIIPEDTFFPSPESS

SEQ ID NO: 19 - protein, 207 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPDIQNPDPAVYQLRDSKSSDKSVCLFTDFDSQTQVSQSKDSDVYITDKCVLDMRSMDFKSQSAVAWSQKSDFACANAFQNSIIPEDTFFPSPESS

SEQ ID NO: 20 - protein, 475 aa, artificial sequence; identical to SEQ ID NO: 13
  synthetic

SEQ ID NO: 21 - protein, 472 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 22 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 213 aa, artificial sequence
  synthetic
DIQLTQSPSFLSASVGDRVTITCSASSTVNYMHWYQQKPGKAPKLLIYSTSNLASGVPSRFSGSGSGTEFTLTISSLQPEDFATYYCHQWSSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24 - protein, 446 aa, artificial sequence
  synthetic
QMQLVQSGPEVKKPGTSVKVSCKASGYAFTSYNMYWVRQARGQRLEWIGYIDPYNGDTTYNQKFKGRVTITRDMSTSTAYMELSSLRSEDTAVYYCLTTAYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 25 - protein, 472 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSRLTVDKSRWQEGNVFSCSVMHEALHNHYTQKSLSLSLGK

SEQ ID NO: 26 - protein, 443 aa, artificial sequence
  synthetic
QMQLVQSGPEVKKPGTSVKVSCKASGYAFTSYNMYWVRQARGQRLEWIGYIDPYNGDTTYNQKFKGRVTITRDMSTSTAYMELSSLRSEDTAVYYCLTTAYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSRLTVDKSRWQEGNVFSCSVMHEALHNHYTQKSLSLSLGK

SEQ ID NO: 27 - protein, 667 aa, artificial sequence
  synthetic
QMQLVQSGPEVKKPGTSVKVSCKASGYAFTSYNMYWVRQARGQRLEWIGYIDPYNGDTTYNQKFKGRVTITRDMSTSTAYMELSSLRSEDTAVYYCLTTAYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVGGGGSGGGGSQMQLVQSGPEVKKPGTSVKVSCKASGYAFTSYNMYWVRQARGQRLEWIGYIDPYNGDTTYNQKFKGRVTITRDMSTSTAYMELSSLRSEDTAVYYCLTTAYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSRLTVDKSRWQEGNVFSCSVMHEALHNHYTQKSLSLSLGK

SEQ ID NO: 28 - protein, 246 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEAWGR

SEQ ID NO: 29 - protein, 248 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEAWGRAD

SEQ ID NO: 30 - protein, 246 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGR

SEQ ID NO: 31 - protein, 248 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRAD

SEQ ID NO: 32 - protein, 116 aa, artificial sequence
  synthetic
EVAVFEPSEAEISHTQKATLVCLATGFYPDHVELSWWVNGKEVHSGVSTDPQPLKEQPALNDSRYALSSRLRVSATFWQNPRNHFRCQVQFYGLSENDEWTQDRAKPVTQIVSAEA

SEQ ID NO: 33 - protein, 116 aa, artificial sequence
  synthetic
EVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEA

SEQ ID NO: 34 - protein, 116 aa, artificial sequence
  synthetic
EVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEA

SEQ ID NO: 35 - protein, 116 aa, artificial sequence
  synthetic
EVAVFEPSEAEISHTQKATLVCLATGFYPDHVELSWWVNGKEVHSGVCTDPQPLKEQPALADSRYALSSRLRVSATFWQNPRNHFRCQVQFYGLSENDEWTQDRAKPVTQIVSAEA

SEQ ID NO: 36 - protein, 116 aa, artificial sequence
  synthetic
EVAVFEPSEAEISHTQKATLVCLATGFYPDHVELSWWVNGKEVHSGVCTDPQPLKEQPALEDSRYALSSRLRVSATFWQNPRNHFRCQVQFYGLSENDEWTQDRAKPVTQIVSAEA

SEQ ID NO: 37 - protein, 102 aa, artificial sequence
  synthetic
EVAVFEPSEAEISHTQKATLVCLATGFYPDHVELSWWVNGKEVHSGVCTDPQPLKEQPALNDSRYALSSRLRVSATFWQNPRNHFRCQVQFYPSNQIVSAEA

SEQ ID NO: 38 - protein, 102 aa, artificial sequence
  synthetic
EVAVFEPSEAEISHTQKATLVCLATGFYPDHVELSWWVNGKEVHSGVCTDPQPLKEQPALQDSRYALSSRLRVSATFWQNPRNHFRCQVQFYPSNQIVSAEA

SEQ ID NO: 39 - protein, 102 aa, artificial sequence
  synthetic
EVAVFEPSEAEISHTQKATLVCLATGFYPDHVELSWWVNGKEVHSGVCTDPQPLKEQPALADSRYALSSRLRVSATFWQNPRNHFRCQVQFYPSNQIVSAEA

SEQ ID NO: 40 - protein, 102 aa, artificial sequence
  synthetic
EVAVFEPSEAEISHTQKATLVCLATGFYPDHVELSWWVNGKEVHSGVCTDPQPLKEQPALEDSRYALSSRLRVSATFWQNPRNHFRCQVQFYPSNQIVSAEA

SEQ ID NO: 41 - protein, 98 aa, artificial sequence
  synthetic
EVAVFEPSEAEISHTQKATLVCLATGFYPDHVELSWWVNGKEVHSGVCTDPQPLKEQSGRYALSSRLRVSATFWQNPRNHFRCQVQFYPSNQIVSAEA

SEQ ID NO: 42 - protein, 87 aa, artificial sequence
  synthetic
AVYQLRDSKSSDKSVCLFTDFDSQTNVSQSKDSDVYITDKTVLDMRSMDFKSNSAVAWSNKSDFACANAFNNSIIPEDTFFPSPESS

SEQ ID NO: 43 - protein, 87 aa, artificial sequence
  synthetic
AVYQLRDSKSSDKSVCLFTDFDSQTNVSQSKDSDVYITDKCVLDMRSMDFKSNSAVAWSNKSDFACANAFNNSIIPEDTFFPSPESS

SEQ ID NO: 44 - protein, 87 aa, artificial sequence
  synthetic
AVYQLRDSKSSDKSVCLFTDFDSQTQVSQSKDSDVYITDKCVLDMRSMDFKSNSAVAWSQKSDFACANAFQNSIIPEDTFFPSPESS

SEQ ID NO: 45 - protein, 87 aa, artificial sequence
  synthetic
AVYQLRDSKSSDKSVCLFTDFDSQTAVSQSKDSDVYITDKCVLDMRSMDFKSNSAVAWSAKSDFACANAFANSIIPEDTFFPSPESS

SEQ ID NO: 46 - protein, 87 aa, artificial sequence
  synthetic
AVYQLRDSKSSDKSVCLFTDFDSQTQVSQSKDSDVYITDKCVLDMRSMDFKSNSAVAWSSKSDFACANAFKNSIIPEDTFFPSPESS

SEQ ID NO: 47 - protein, 87 aa, artificial sequence
  synthetic
AVYQLRDSKSSDKSVCLFTDFDSQTAVSQSKDSDVYITDKCVLDMRSMDFKSNSAVAWSSKSDFACANAFKNSIIPEDTFFPSPESS

SEQ ID NO: 48 - protein, 87 aa, artificial sequence
  synthetic
AVYQLRDSKSSDKSVCLFTDFDSQTQVSQSKDSDVYITDKCVLDMRSMDFKSQSAVAWSQKSDFACANAFQNSIIPEDTFFPSPESS

SEQ ID NO: 49 - protein, 10 aa, artificial sequence
  synthetic
SSASKNVFPP

SEQ ID NO: 50 - protein, 10 aa, artificial sequence
  synthetic
LEDLKNVFPP

SEQ ID NO: 51 - protein, 9 aa, artificial sequence
  synthetic
KRTVAAPDP

SEQ ID NO: 52 - protein, 9 aa, artificial sequence
  synthetic
KPDIQNPDP

SEQ ID NO: 53 - protein, 23 aa, artificial sequence
  synthetic
WGRASDKTHTCPPCPAPEAAGGP

SEQ ID NO: 54 - protein, 20 aa, artificial sequence
  synthetic
WGRYGPPCPPCPAPEFLGGP

SEQ ID NO: 55 - protein, 17 aa, artificial sequence
  synthetic
RVTVEPRSQPHTKPSVF

SEQ ID NO: 56 - protein, 13 aa, artificial sequence
  synthetic
LVTVSSASTKGPS

SEQ ID NO: 57 - protein, 15 aa, artificial sequence
  synthetic
RVTVEPRSQPHTKPS

SEQ ID NO: 58 - protein, 14 aa, artificial sequence
  synthetic
KVEIKRTVAAPSVF

SEQ ID NO: 59 - protein, 18 aa, artificial sequence
  synthetic
TLVVTDKQLDADVSPKPT

SEQ ID NO: 60 - protein, 11 aa, artificial sequence
  synthetic
EPKSCDKTHTC

SEQ ID NO: 61 - protein, 8 aa, artificial sequence
  synthetic
ESKYGPPC

SEQ ID NO: 62 - protein, 11 aa, artificial sequence
  synthetic
PPIKTDVITMD

SEQ ID NO: 63 - protein, 230 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPTGVGGTPFPSLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTARTC

SEQ ID NO: 64 - protein, 229 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPTGVGGTPFPSLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 65 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 229 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPTGVGGTPFPSLAPPIMLLVDGKQQMVVVCLVLDVAPPGLDSPIWFSAGQGSALDAFTCGPSPATDGTWTNLAHLSLPSEELASWEPLVCHTGPGAEGHSRSTQPMHLSGEASTART

SEQ ID NO: 67 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVSTDPQPLKEQPALQDSRYALCSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 229 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPTGVGGTPFPSLCPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 69 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVCEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPCEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 229 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPTGVGGTPFPCLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 72 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSECEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEACISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 229 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPTGVGGTPFPSLAPPIMLLVDGKQQMVVVCLVLDVAPPGLDSPIWFSAGQGSALDAFTYGPCPATDGTWTNLAHLSLPSEELASWEPLVCHTGPGAEGHSRSTQPMHLSGEASTART

SEQ ID NO: 75 - protein, 475 aa, artificial sequence; identical to SEQ ID NO: 13
  synthetic

SEQ ID NO: 76 - protein, 229 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPTGVGGTPFPSLAPPIMLLVDGKQQMVVVCLVLDVAPPGLDSPIWFSAGQGSALDAFTYGPSPACDGTWTNLAHLSLPSEELASWEPLVCHTGPGAEGHSRSTQPMHLSGEASTART

SEQ ID NO: 77 - protein, 229 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPTGVGGTPFPSLAPPCMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 78 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVCVFEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 476 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRADCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 476 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRADCGFTSVCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 8 aa, artificial sequence
  synthetic
PTGVGGTP

SEQ ID NO: 82 - protein, 109 aa, artificial sequence
  synthetic
FPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTART

SEQ ID NO: 83 - protein, 109 aa, artificial sequence
  synthetic
FPSLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 84 - protein, 116 aa, artificial sequence
  synthetic
EVAVFEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA

SEQ ID NO: 85 - protein, 200 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIEPRSQPHTKPSVFVMKQGTNVACLVKEFYPKDIRINLVSSKKITEFDPAIVISPSGKYNAVKLGKYEDSNSVTCSVQHDQKTVHSTDFE

SEQ ID NO: 86 - protein, 455 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVTDKQLDADVSPKPTIFLPSIAETKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 4 aa, artificial sequence
  synthetic
QSGR

SEQ ID NO: 88 - protein, 8 aa, Homo sapiens
QPALNDSR

SEQ ID NO: 89 - protein, 200 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIEPRSQPHTKPSVFVMKCGTNVACLVKEFYPKDIRINLVSSKKITEFDPAIVISPSGKYNAVKLGKYEDSNSVTCSVQHDQKTVHSTDFE

SEQ ID NO: 90 - protein, 455 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVTDKQLDADVSPKPCIFLPSIAETKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 200 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIEPRSQPHTKPSVFVMKQGTNVACLVKEFYPKDIRINLVSSKKITEFDPAICISPSGKYNAVKLGKYEDSNSVTCSVQHDQKTVHSTDFE

SEQ ID NO: 92 - protein, 455 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVTDKQLDADVSPKPTIFLPSIAETKLQKAGTYLCLLEKFFPDVIKIHWQEKKSNTILGSCEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 200 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIEPRSQPHTKPSVFVMKQGTNVACLVKEFYPKDIRINLVSSKKITEFCPAIVISPSGKYNAVKLGKYEDSNSVTCSVQHDQKTVHSTDFE

SEQ ID NO: 94 - protein, 455 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVTDKQLDADVSPKPTIFLPSIAETKLQKAGTYLCLLEKFFPDVIKIHWQEKKSNTILGSQEGNTCKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 200 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIEPRSQPHTKPSVCVMKQGTNVACLVKEFYPKDIRINLVSSKKITEFDPAIVISPSGKYNAVKLGKYEDSNSVTCSVQHDQKTVHSTDFE

SEQ ID NO: 96 - protein, 455 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVTDKQLDADVSPKPTIFLPCIAETKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 200 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIEPRSQPHTKPSVFVCKQGTNVACLVKEFYPKDIRINLVSSKKITEFDPAIVISPSGKYNAVKLGKYEDSNSVTCSVQHDQKTVHSTDFE

SEQ ID NO: 98 - protein, 455 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVTDKQLDADVSPKPTICLPSIAETKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 455 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVTDKQLDADVSPKPTIFLPSIACTKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 200 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIEPRSQPHTKPSVFVMKQGTNVACLVKEFYPKDIRINLVSSKKITEFDPAIVISPSGKYNAVKLGKYEDSNSVTCSVQHDQKTVHSTDCE

SEQ ID NO: 101 - protein, 455 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVTDKQLDADVSPKPTIFLPSICETKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 200 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIEPRSQPHTKPSVFVMKQGTNVACLVKEFYPKDIRINLVSSKKITEFDPAIVISPSGKYNAVKLGKYEDSNSVTCSVQHDQKTVHSTDFC

SEQ ID NO: 103 - protein, 8 aa, artificial sequence
  synthetic
ESKYGPPC

SEQ ID NO: 104 - protein, 11 aa, artificial sequence
  synthetic
FEVKTDSTDHV

SEQ ID NO: 105 - protein, 200 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIEPRSQPHTKPSVFVMKNGTNVACLVKEFYPKDIRINLVSSKKITEFDPAIVISPSGKYNAVKLGKYEDSNSVTCSVQHDNKTVHSTDFE

SEQ ID NO: 106 - protein, 455 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVTDKQLDADVSPKPTIFLPSIAETKLQKAGTYLCLLEKFFPDVIKIHWQEKKSNTILGSQEGNTMKTNDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 200 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKPRSQPHTKPSVFVMKNGTNVACLVKEFYPKDIRINLVSSKKITEFDPAIVISPSGKYNAVKLGKYEDSNSVTCSVQHDNKTVHSTDFE

SEQ ID NO: 108 - protein, 455 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVSSASLDADVSPKPTIFLPSIAETKLQKAGTYLCLLEKFFPDVIKIHWQEKKSNTILGSQEGNTMKTNDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - protein, 228 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKDKQLDADVSPKPTIFLPSIAETKLQKAGTYLCLLEKFFPDVIKIHWQEKKSNTILGSCEGNTMKTQDTYMKFSWLTVPEESLDKEHRCIVRHENNKNGVDQEIIFPPIKTDVITMD

SEQ ID NO: 110 - protein, 436 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVSSRSQPHTKPSVFVMKQGTNVACLVKEFYPKDIRINLVSSKKITEFDPAICISPSGKYNAVKLGKYEDSNSVTCSVQHDQKTVHSTDEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - protein, 228 aa, artificial sequence; identical to SEQ ID NO: 109
  synthetic

SEQ ID NO: 112 - protein, 436 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVEPRSQPHTKPSVFVMKQGTNVACLVKEFYPKDIRINLVSSKKITEFDPAICISPSGKYNAVKLGKYEDSNSVTCSVQHDQKTVHSTDEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 95 aa, artificial sequence
  synthetic
KPTIFLPSIAETKLQKAGTYLCLLEKFFPDVIKIHWQEKKSNTILGSQEGNTMKTNDTYMKFSWLTVPEESLDKEHRCIVRHENNKNGVDQEIIF

SEQ ID NO: 114 - protein, 95 aa, artificial sequence
  synthetic
KPTIFLPSIAETKLQKAGTYLCLLEKFFPDVIKIHWQEKKSNTILGSQEGNTMKTQDTYMKFSWLTVPEESLDKEHRCIVRHENNKNGVDQEIIF

SEQ ID NO: 115 - protein, 79 aa, artificial sequence
  synthetic
SVFVMKNGTNVACLVKEFYPKDIRINLVSSKKITEFDPAIVISPSGKYNAVKLGKYEDSNSVTCSVQHDNKTVHSTDFE

SEQ ID NO: 116 - protein, 79 aa, artificial sequence
  synthetic
SVFVMKQGTNVACLVKEFYPKDIRINLVSSKKITEFDPAIVISPSGKYNAVKLGKYEDSNSVTCSVQHDQKTVHSTDFE

SEQ ID NO: 117 - protein, 11 aa, artificial sequence
  synthetic
SSASLDADVSP

SEQ ID NO: 118 - protein, 11 aa, artificial sequence
  synthetic
TDKQLDADVSP

SEQ ID NO: 119 - protein, 9 aa, artificial sequence
  synthetic
PRSQPHTKP

SEQ ID NO: 120 - protein, 10 aa, artificial sequence
  synthetic
EPRSQPHTKP

SEQ ID NO: 121 - protein, 23 aa, artificial sequence
  synthetic
PPIKSDKTHTCPPCPAPEAAGGP

SEQ ID NO: 122 - protein, 20 aa, artificial sequence
  synthetic
PPIYGPPCPPCPAPEFLGGP

SEQ ID NO: 123 - protein, 10 aa, artificial sequence
  synthetic
SSRSQPHTKP

SEQ ID NO: 124 - protein, 10 aa, artificial sequence
  synthetic
EPRSQPHTKP

SEQ ID NO: 125 - protein, 10 aa, artificial sequence
  synthetic
KDKLDADVSP

SEQ ID NO: 126 - protein, 10 aa, artificial sequence
  synthetic
TDKLDADVSP

SEQ ID NO: 127 - protein, 23 aa, artificial sequence
  synthetic
EPKSSDKTHTCPPCPAPEAAGGP

SEQ ID NO: 128 - protein, 20 aa, artificial sequence
  synthetic
ESKYGPPCPPCPAPEFLGGP

SEQ ID NO: 129 - protein, 10 aa, artificial sequence
  synthetic
SSASIQNPDP

SEQ ID NO: 130 - protein, 10 aa, artificial sequence
  synthetic
SSPDIQNPDP

SEQ ID NO: 131 - protein, 8 aa, artificial sequence
  synthetic
RTVAAGTP

SEQ ID NO: 132 - protein, 10 aa, artificial sequence
  synthetic
SSASGVGGTP

SEQ ID NO: 133 - protein, 10 aa, artificial sequence
  synthetic
SSPTGVGGTP

SEQ ID NO: 134 - protein, 19 aa, artificial sequence
  synthetic
SDKTHTCPPCPAPEAAGGP

SEQ ID NO: 135 - protein, 17 aa, artificial sequence
  synthetic
YGPPCPPCPAPEFLGGP

SEQ ID NO: 136 - protein, 242 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKLEDLKNVFPPEVAVFEPCEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRA

SEQ ID NO: 137 - protein, 464 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVSSASGVGGTPFPCLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTARTSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - protein, 464 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVSSPTGVGGTPFPCLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTARTSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 139 - protein, 242 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIKLEDLKNVFPPEVAVFEPSECEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRA

SEQ ID NO: 140 - protein, 19 aa, artificial sequence
  synthetic
SDKTHTCPPCPAPEAAGGP

SEQ ID NO: 141 - protein, 17 aa, artificial sequence
  synthetic
YGPPCPPCPAPEFLGGP

SEQ ID NO: 142 - protein, 16 aa, artificial sequence
  synthetic
TLVVTDKQLDADVSPK

SEQ ID NO: 143 - protein, 14 aa, artificial sequence
  synthetic
KVEIKRTVAAPSVF

SEQ ID NO: 144 - protein, 15 aa, artificial sequence
  synthetic
LVTVSSASKNVFPPE

SEQ ID NO: 145 - protein, 15 aa, artificial sequence
  synthetic
LVTVLEDLKNVFPPE

SEQ ID NO: 146 - protein, 14 aa, artificial sequence
  synthetic
KVEIKRTVAAPDPA

SEQ ID NO: 147 - protein, 14 aa, artificial sequence
  synthetic
KVEIKPDIQNPDPA

SEQ ID NO: 148 - protein, 15 aa, artificial sequence
  synthetic
LVTVSSASIQNPDPA

SEQ ID NO: 149 - protein, 15 aa, artificial sequence
  synthetic
LVTVSSPDIQNPDPA

SEQ ID NO: 150 - protein, 16 aa, artificial sequence
  synthetic
KVEIKLEDLKNVFPPE

SEQ ID NO: 151 - protein, 131 aa, artificial sequence
  synthetic
KLEDLKNVFPPEVAVFEPSECEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRA

SEQ ID NO: 152 - protein, 11 aa, artificial sequence
  synthetic
WGRASDKTHTC

SEQ ID NO: 153 - protein, 8 aa, artificial sequence
  synthetic
WGRYGPPC

SEQ ID NO: 154 - protein, 7 aa, artificial sequence
  synthetic
SDKTHTC

SEQ ID NO: 155 - protein, 5 aa, artificial sequence
  synthetic
YGPPC

SEQ ID NO: 156 - protein, 14 aa, artificial sequence
  synthetic
KVEIKPTGVGGTPF

SEQ ID NO: 157 - protein, 16 aa, artificial sequence
  synthetic
LVTVSSASLDADVSPK

SEQ ID NO: 158 - protein, 16 aa, artificial sequence
  synthetic
LVTVTDKQLDADVSPK

SEQ ID NO: 159 - protein, 17 aa, artificial sequence
  synthetic
KVEIKPRSQPHTKPSVF

SEQ ID NO: 160 - protein, 17 aa, artificial sequence
  synthetic
KVEIEPRSQPHTKPSVF

SEQ ID NO: 161 - protein, 15 aa, artificial sequence
  synthetic
LVTVSSRSQPHTKPS

SEQ ID NO: 162 - protein, 15 aa, artificial sequence
  synthetic
LVTVEPRSQPHTKPS

SEQ ID NO: 163 - protein, 18 aa, artificial sequence
  synthetic
KVEIKDKQLDADVSPKPT

SEQ ID NO: 164 - protein, 18 aa, artificial sequence
  synthetic
KVEITDKQLDADVSPKPT

SEQ ID NO: 165 - protein, 11 aa, artificial sequence
  synthetic
PPIKSDKTHTC

SEQ ID NO: 166 - protein, 8 aa, artificial sequence
  synthetic
PPIYGPPC

SEQ ID NO: 167 - protein, 11 aa, artificial sequence
  synthetic
EPKSSDKTHTC

SEQ ID NO: 168 - protein, 8 aa, artificial sequence
  synthetic
ESKYGPPC

SEQ ID NO: 169 - protein, 14 aa, artificial sequence
  synthetic
KVEIKRTVAAGTPF

SEQ ID NO: 170 - protein, 15 aa, artificial sequence
  synthetic
LVTVSSASKNVFPPE

SEQ ID NO: 171 - protein, 15 aa, artificial sequence
  synthetic
LVTVLEDLKNVFPPE

SEQ ID NO: 172 - protein, 15 aa, artificial sequence
  synthetic
LVTVSSASGVGGTPF

SEQ ID NO: 173 - protein, 15 aa, artificial sequence
  synthetic
LVTVSSPTGVGGTPF

SEQ ID NO: 174 - protein, 16 aa, artificial sequence
  synthetic
KVEIKLEDLKNVFPPE

SEQ ID NO: 175 - protein, 16 aa, artificial sequence
  synthetic
KVEIKLEDLKNVFPPE

SEQ ID NO: 176 - protein, 96 aa, artificial sequence
  synthetic
KRTVAAPDPAVYQLRDSKSSDKSVCLFTDFDSQTNVSQSKDSDVYITDKCVLDMRSMDFKSNSAVAWSNKSDFACANAFNNSIIPEDTFFPSPESS

SEQ ID NO: 177 - protein, 358 aa, artificial sequence
  synthetic
SSASKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - protein, 96 aa, artificial sequence
  synthetic
KPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESS

SEQ ID NO: 179 - protein, 358 aa, artificial sequence
  synthetic
LEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 344 aa, artificial sequence
  synthetic
SSASKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYPSNQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 344 aa, artificial sequence
  synthetic
LEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYPSNQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 340 aa, artificial sequence
  synthetic
LEDLKNVFPPEVAVFEPSEAEISHTQKATLVCLATGFYPDHVELSWWVNGKEVHSGVCTDPQPLKEQSGRYALSSRLRVSATFWQNPRNHFRCQVQFYPSNQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 131 aa, artificial sequence
  synthetic
KLEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEAWGRA

SEQ ID NO: 184 - protein, 325 aa, artificial sequence
  synthetic
SSASIQNPDPAVYQLRDSKSSDKSVCLFTDFDSQTNVSQSKDSDVYITDKCVLDMRSMDFKSNSAVAWSNKSDFACANAFNNSIIPEDTFFPSPESSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 325 aa, artificial sequence
  synthetic
SSPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 186 - protein, 117 aa, artificial sequence
  synthetic
KLEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYPSNQIVSAEAWGRA

SEQ ID NO: 187 - protein, 96 aa, artificial sequence
  synthetic
KPDIQNPDPAVYQLRDSKSSDKSVCLFTDFDSQTQVSQSKDSDVYITDKCVLDMRSMDFKSNSAVAWSQKSDFACANAFQNSIIPEDTFFPSPESS

SEQ ID NO: 188 - protein, 358 aa, artificial sequence
  synthetic
LEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 189 - protein, 96 aa, artificial sequence
  synthetic
KPDIQNPDPAVYQLRDSKSSDKSVCLFTDFDSQTAVSQSKDSDVYITDKCVLDMRSMDFKSNSAVAWSAKSDFACANAFANSIIPEDTFFPSPESS

SEQ ID NO: 190 - protein, 358 aa, artificial sequence
  synthetic
LEDLKNVFPPEVAVFEPSEAEISHTQKATLVCLATGFYPDHVELSWWVNGKEVHSGVCTDPQPLKEQPALADSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 191 - protein, 96 aa, artificial sequence
  synthetic
KPDIQNPDPAVYQLRDSKSSDKSVCLFTDFDSQTQVSQSKDSDVYITDKCVLDMRSMDFKSNSAVAWSSKSDFACANAFKNSIIPEDTFFPSPESS

SEQ ID NO: 192 - protein, 358 aa, artificial sequence
  synthetic
LEDLKNVFPPEVAVFEPSEAEISHTQKATLVCLATGFYPDHVELSWWVNGKEVHSGVCTDPQPLKEQPALEDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 193 - protein, 96 aa, artificial sequence
  synthetic
KPDIQNPDPAVYQLRDSKSSDKSVCLFTDFDSQTAVSQSKDSDVYITDKCVLDMRSMDFKSNSAVAWSSKSDFACANAFKNSIIPEDTFFPSPESS

SEQ ID NO: 194 - protein, 96 aa, artificial sequence
  synthetic
KPDIQNPDPAVYQLRDSKSSDKSVCLFTDFDSQTQVSQSKDSDVYITDKCVLDMRSMDFKSQSAVAWSQKSDFACANAFQNSIIPEDTFFPSPESS

SEQ ID NO: 195 - protein, 358 aa, artificial sequence; identical to SEQ ID NO: 188
  synthetic

SEQ ID NO: 196 - protein, 355 aa, artificial sequence
  synthetic
LEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 197 - protein, 118 aa, artificial sequence
  synthetic
KPTGVGGTPFPSLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 198 - protein, 358 aa, artificial sequence
  synthetic
LEDLKNVFPPEVAVFEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 199 - protein, 118 aa, artificial sequence
  synthetic
KPTGVGGTPFPSLAPPIMLLVDGKQQMVVVCLVLDVAPPGLDSPIWFSAGQGSALDAFTCGPSPATDGTWTNLAHLSLPSEELASWEPLVCHTGPGAEGHSRSTQPMHLSGEASTART

SEQ ID NO: 200 - protein, 358 aa, artificial sequence
  synthetic
LEDLKNVFPPEVAVFEPSEAEISHTQKATLVCLATGFYPDHVELSWWVNGKEVHSGVSTDPQPLKEQPALQDSRYALCSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 201 - protein, 118 aa, artificial sequence
  synthetic
KPTGVGGTPFPSLCPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 202 - protein, 358 aa, artificial sequence
  synthetic
LEDLKNVFPPEVAVCEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - protein, 358 aa, artificial sequence
  synthetic
LEDLKNVFPPEVAVFEPCEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 118 aa, artificial sequence
  synthetic
KPTGVGGTPFPCLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 205 - protein, 358 aa, artificial sequence
  synthetic
LEDLKNVFPPEVAVFEPSECEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 358 aa, artificial sequence
  synthetic
LEDLKNVFPPEVAVFEPSEACISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - protein, 118 aa, artificial sequence
  synthetic
KPTGVGGTPFPSLAPPIMLLVDGKQQMVVVCLVLDVAPPGLDSPIWFSAGQGSALDAFTYGPCPATDGTWTNLAHLSLPSEELASWEPLVCHTGPGAEGHSRSTQPMHLSGEASTART

SEQ ID NO: 208 - protein, 358 aa, artificial sequence; identical to SEQ ID NO: 188
  synthetic

SEQ ID NO: 209 - protein, 118 aa, artificial sequence
  synthetic
KPTGVGGTPFPSLAPPIMLLVDGKQQMVVVCLVLDVAPPGLDSPIWFSAGQGSALDAFTYGPSPACDGTWTNLAHLSLPSEELASWEPLVCHTGPGAEGHSRSTQPMHLSGEASTART

SEQ ID NO: 210 - protein, 118 aa, artificial sequence
  synthetic
KPTGVGGTPFPSLAPPCMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 211 - protein, 358 aa, artificial sequence
  synthetic
LEDLKNVFPPEVCVFEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRASDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - protein, 131 aa, artificial sequence
  synthetic
KLEDLKNVFPPEVAVFEPCEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEAWGRA

SEQ ID NO: 213 - protein, 347 aa, artificial sequence
  synthetic
SSASGVGGTPFPCLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTARTSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 347 aa, artificial sequence
  synthetic
SSPTGVGGTPFPCLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTARTSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 215 - protein, 89 aa, artificial sequence
  synthetic
EPRSQPHTKPSVFVMKQGTNVACLVKEFYPKDIRINLVSSKKITEFDPAIVISPSGKYNAVKLGKYEDSNSVTCSVQHDQKTVHSTDFE

SEQ ID NO: 216 - protein, 338 aa, artificial sequence
  synthetic
TDKQLDADVSPKPTIFLPSIAETKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 217 - protein, 89 aa, artificial sequence
  synthetic
EPRSQPHTKPSVFVMKCGTNVACLVKEFYPKDIRINLVSSKKITEFDPAIVISPSGKYNAVKLGKYEDSNSVTCSVQHDQKTVHSTDFE

SEQ ID NO: 218 - protein, 338 aa, artificial sequence
  synthetic
TDKQLDADVSPKPCIFLPSIAETKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 219 - protein, 89 aa, artificial sequence
  synthetic
EPRSQPHTKPSVFVMKQGTNVACLVKEFYPKDIRINLVSSKKITEFDPAICISPSGKYNAVKLGKYEDSNSVTCSVQHDQKTVHSTDFE

SEQ ID NO: 220 - protein, 338 aa, artificial sequence
  synthetic
TDKQLDADVSPKPTIFLPSIAETKLQKAGTYLCLLEKFFPDVIKIHWQEKKSNTILGSCEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - protein, 89 aa, artificial sequence
  synthetic
EPRSQPHTKPSVFVMKQGTNVACLVKEFYPKDIRINLVSSKKITEFCPAIVISPSGKYNAVKLGKYEDSNSVTCSVQHDQKTVHSTDFE

SEQ ID NO: 222 - protein, 338 aa, artificial sequence
  synthetic
TDKQLDADVSPKPTIFLPSIAETKLQKAGTYLCLLEKFFPDVIKIHWQEKKSNTILGSQEGNTCKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 223 - protein, 89 aa, artificial sequence
  synthetic
EPRSQPHTKPSVCVMKQGTNVACLVKEFYPKDIRINLVSSKKITEFDPAIVISPSGKYNAVKLGKYEDSNSVTCSVQHDQKTVHSTDFE

SEQ ID NO: 224 - protein, 338 aa, artificial sequence
  synthetic
TDKQLDADVSPKPTIFLPCIAETKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 225 - protein, 89 aa, artificial sequence
  synthetic
EPRSQPHTKPSVFVCKQGTNVACLVKEFYPKDIRINLVSSKKITEFDPAIVISPSGKYNAVKLGKYEDSNSVTCSVQHDQKTVHSTDFE

SEQ ID NO: 226 - protein, 338 aa, artificial sequence
  synthetic
TDKQLDADVSPKPTICLPSIAETKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 227 - protein, 338 aa, artificial sequence
  synthetic
TDKQLDADVSPKPTIFLPSIACTKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 228 - protein, 89 aa, artificial sequence
  synthetic
EPRSQPHTKPSVFVMKQGTNVACLVKEFYPKDIRINLVSSKKITEFDPAIVISPSGKYNAVKLGKYEDSNSVTCSVQHDQKTVHSTDCE

SEQ ID NO: 229 - protein, 338 aa, artificial sequence
  synthetic
TDKQLDADVSPKPTIFLPSICETKLQKAGTYLCLLEKFFPDVIKIHWQEKKSNTILGSQEGNTMKTQDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - protein, 89 aa, artificial sequence
  synthetic
EPRSQPHTKPSVFVMKQGTNVACLVKEFYPKDIRINLVSSKKITEFDPAIVISPSGKYNAVKLGKYEDSNSVTCSVQHDQKTVHSTDFC

SEQ ID NO: 231 - protein, 89 aa, artificial sequence
  synthetic
EPRSQPHTKPSVFVMKNGTNVACLVKEFYPKDIRINLVSSKKITEFDPAIVISPSGKYNAVKLGKYEDSNSVTCSVQHDNKTVHSTDFE

SEQ ID NO: 232 - protein, 338 aa, artificial sequence
  synthetic
TDKQLDADVSPKPTIFLPSIAETKLQKAGTYLCLLEKFFPDVIKIHWQEKKSNTILGSQEGNTMKTNDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - protein, 89 aa, artificial sequence
  synthetic
KPRSQPHTKPSVFVMKNGTNVACLVKEFYPKDIRINLVSSKKITEFDPAIVISPSGKYNAVKLGKYEDSNSVTCSVQHDNKTVHSTDFE

SEQ ID NO: 234 - protein, 338 aa, artificial sequence
  synthetic
SSASLDADVSPKPTIFLPSIAETKLQKAGTYLCLLEKFFPDVIKIHWQEKKSNTILGSQEGNTMKTNDTYMKFSWLTVPEESLDKEHRCIVRHENNKNGVDQEIIFPPIKSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 235 - protein, 117 aa, artificial sequence
  synthetic
KDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMD

SEQ ID NO: 236 - protein, 319 aa, artificial sequence
  synthetic
SSRSQPHTKPSVFVMKQGTNVACLVKEFYPKDIRINLVSSKKITEFDPAICISPSGKYNAVKLGKYEDSNSVTCSVQHDQKTVHSTDEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 237 - protein, 117 aa, artificial sequence; identical to SEQ ID NO: 235
  synthetic

SEQ ID NO: 238 - protein, 319 aa, artificial sequence
  synthetic
EPRSQPHTKPSVFVMKQGTNVACLVKEFYPKDIRINLVSSKKITEFDPAICISPSGKYNAVKLGKYEDSNSVTCSVQHDQKTVHSTDEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 95 aa, artificial sequence
  synthetic
PNIQNPDPAVYQLRDSKSSDKSVCLFTDFDSQTNVSQSKDSDVYITDKTVLDMRSMDFKSNSAVAWSNKSDFACANAFNNSIIPEDTFFPSPESS

SEQ ID NO: 240 - protein, 95 aa, artificial sequence
  synthetic
PDIQNPDPAVYQLRDSKSSDKSVCLFTDFDSQTNVSQSKDSDVYITDKCVLDMRSMDFKSNSAVAWSNKSDFACANAFNNSIIPEDTFFPSPESS

SEQ ID NO: 241 - protein, 95 aa, artificial sequence
  synthetic
PDIQNPDPAVYQLRDSKSSDKSVCLFTDFDSQTQVSQSKDSDVYITDKCVLDMRSMDFKSNSAVAWSQKSDFACANAFQNSIIPEDTFFPSPESS

SEQ ID NO: 242 - protein, 129 aa, Homo sapiens
EDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRA

SEQ ID NO: 243 - protein, 130 aa, artificial sequence
  synthetic
LEDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEAWGRA

SEQ ID NO: 244 - protein, 130 aa, artificial sequence
  synthetic
LEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRA

SEQ ID NO: 245 - protein, 117 aa, Homo sapiens
PTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTART

SEQ ID NO: 246 - protein, 117 aa, artificial sequence; identical to SEQ ID NO: 245
  synthetic

SEQ ID NO: 247 - protein, 117 aa, artificial sequence
  synthetic
PTGVGGTPFPCLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 248 - protein, 89 aa, Homo sapiens; identical to SEQ ID NO: 231

SEQ ID NO: 249 - protein, 89 aa, artificial sequence; identical to SEQ ID NO: 231
  synthetic

SEQ ID NO: 250 - protein, 89 aa, artificial sequence; identical to SEQ ID NO: 230
  synthetic

SEQ ID NO: 251 - protein, 106 aa, Homo sapiens
TDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIF

SEQ ID NO: 252 - protein, 106 aa, artificial sequence
  synthetic
TDKQLDADVSPKPTIFLPSIAETKLQKAGTYLCLLEKFFPDVIKIHWQEKKSNTILGSQEGNTMKTNDTYMKFSWLTVPEESLDKEHRCIVRHENNKNGVDQEIIF

SEQ ID NO: 253 - protein, 106 aa, artificial sequence
  synthetic
TDKQLDADVSPKPTIFLPSICETKLQKAGTYLCLLEKFFPDVIKIHWQEKKSNTILGSQEGNTMKTQDTYMKFSWLTVPEESLDKEHRCIVRHENNKNGVDQEIIF

SEQ ID NO: 254 - protein, 142 aa, Homo sapiens
PNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 255 - protein, 95 aa, artificial sequence; identical to SEQ ID NO: 240
  synthetic

SEQ ID NO: 256 - protein, 177 aa, Homo sapiens
EDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 257 - protein, 178 aa, Homo sapiens
DLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 258 - protein, 130 aa, artificial sequence
  synthetic
EDLKNVFPPEVAVFEPSEAEISHTQKATLVCLATGFYPDHVELSWWVNGKEVHSGVCTDPQPLKEQPALNDSRYALSSRLRVSATFWQNPRNHFRCQVQFYGLSENDEWTQDRAKPVTQIVSAEAWGRAD

SEQ ID NO: 259 - protein, 281 aa, Homo sapiens
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 260 - protein, 130 aa, artificial sequence
  synthetic
GAHMLPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCSGDDDDK

SEQ ID NO: 261 - protein, 296 aa, Homo sapiens
MLFSSLLCVFVAFSYSGSSVAQKVTQAQSSVSMPVRKAVTLNCLYETSWWSYYIFWYKQLPSKEMIFLIRQGSDEQNAKSGRYSVNFKKAAKSVALTISALQLEDSAKYFCALGESFLPFRGNFHYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 262 - protein, 236 aa, artificial sequence [sequence omitted]

SEQ ID NO: 263 - protein, 173 aa, Homo sapiens
DKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 264 - protein, 127 aa, artificial sequence
  synthetic
DKQLDADVSPKPTIFLPSIAETKLQKAGTYLCLLEKFFPDVIKIHWQEKKSNTILGSQEGNTMKTNDTYMKFSWLTVPEESLDKEHRCIVRHENNKNGVDQEIIFPPIKTDVITMDPKDNASGLVPR

SEQ ID NO: 265 - protein, 189 aa, Homo sapiens
DKQLDADVSPKPTIFLPSIAETKLQKAGTYLCLLEKFFPDIIKIHWQEKKSNTILGSQEGNTMKTNDTYMKFSWLTVPEESLDKEHRCIVRHENNKNGIDQEIIFPPIKTDVTTVDPKDSYSKDANDVITMDPKDNWSKDANDTLLLQLTNTSAYYMYLLLLLKSVVYFAIITCCLLGRTAFCCNGEKS

SEQ ID NO: 266 - protein, 5 aa, artificial sequence
  synthetic
TGGGG

SEQ ID NO: 267 - protein, 5 aa, artificial sequence
  synthetic
GGGGS

SEQ ID NO: 268 - protein, 5 aa, artificial sequence
  synthetic
SGGGG

SEQ ID NO: 269 - protein, 18 aa, artificial sequence
  synthetic
GAPGGGGGAAAAAGGGGG

SEQ ID NO: 270 - protein, 13 aa, artificial sequence
  synthetic
LVTVSSASTKGPS

SEQ ID NO: 271 - protein, 15 aa, artificial sequence
  synthetic
RLTVLEDLKNVFPPE

SEQ ID NO: 272 - protein, 14 aa, artificial sequence
  synthetic
KVEIKRTVAAPSVF

SEQ ID NO: 273 - protein, 14 aa, artificial sequence
  synthetic
KLIIKPDIQNPDPA

SEQ ID NO: 274 - protein, 13 aa, artificial sequence
  synthetic
LVTVSSASTKGPS

SEQ ID NO: 275 - protein, 14 aa, artificial sequence
  synthetic
KLIIKPDIQNPDPA

SEQ ID NO: 276 - protein, 14 aa, artificial sequence
  synthetic
KVEIKRTVAAPSVF

SEQ ID NO: 277 - protein, 15 aa, artificial sequence
  synthetic
RLTVLEDLKNVFPPE

SEQ ID NO: 278 - protein, 11 aa, artificial sequence
  synthetic
EPKSCDKTHTC

SEQ ID NO: 279 - protein, 8 aa, artificial sequence
  synthetic
ESKYGPPC

SEQ ID NO: 280 - protein, 12 aa, artificial sequence
  synthetic
WGRADCGFTSVS

SEQ ID NO: 281 - protein, 11 aa, artificial sequence
  synthetic
EPKSCDKTHTC

SEQ ID NO: 282 - protein, 8 aa, artificial sequence
  synthetic
ESKYGPPC

SEQ ID NO: 283 - protein, 13 aa, artificial sequence
  synthetic
LVTVSSASTKGPS

SEQ ID NO: 284 - protein, 15 aa, artificial sequence
  synthetic
RLTVLEDLKNVFPPE

SEQ ID NO: 285 - protein, 14 aa, artificial sequence
  synthetic
KVEIKRTVAAPSVF

SEQ ID NO: 286 - protein, 14 aa, artificial sequence
  synthetic
KLIIKPDIQNPDPA

SEQ ID NO: 287 - protein, 14 aa, artificial sequence
  synthetic
GCPALPTGVGGTPF

SEQ ID NO: 288 - protein, 13 aa, artificial sequence
  synthetic
LVTVSSASTKGPS

SEQ ID NO: 289 - protein, 14 aa, artificial sequence
  synthetic
KLIIKPDIQNPDPA

SEQ ID NO: 290 - protein, 14 aa, artificial sequence
  synthetic
GCPALPTGVGGTPF

SEQ ID NO: 291 - protein, 14 aa, artificial sequence
  synthetic
KVEIKRTVAAPSVF

SEQ ID NO: 292 - protein, 15 aa, artificial sequence
  synthetic
RLTVLEDLKNVFPPE

SEQ ID NO: 293 - protein, 13 aa, artificial sequence
  synthetic
LVTVSSASTKGPS

SEQ ID NO: 294 - protein, 232 aa, artificial sequence
  synthetic
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 232 aa, artificial sequence
  synthetic
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - protein, 232 aa, artificial sequence
  synthetic
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 297 - protein, 229 aa, artificial sequence
  synthetic
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 298 - protein, 229 aa, artificial sequence
  synthetic
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSRLTVDKSRWQEGNVFSCSVMHEALHNHYTQKSLSLSLGK

SEQ ID NO: 299 - protein, 229 aa, artificial sequence
  synthetic
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSRLTVDKSRWQEGNVFSCSVMHEALHNHYTQKSLSLSLGK

SEQ ID NO: 300 - protein, 117 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTV

SEQ ID NO: 301 - protein, 111 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEI

SEQ ID NO: 302 - protein, 209 aa, artificial sequence
  synthetic
SVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - protein, 209 aa, artificial sequence
  synthetic
SVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 304 - protein, 209 aa, artificial sequence
  synthetic
SVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 209 aa, artificial sequence
  synthetic
SVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSRLTVDKSRWQEGNVFSCSVMHEALHNHYTQKSLSLSLGK

SEQ ID NO: 306 - protein, 4 aa, artificial sequence
  synthetic
WGRA

SEQ ID NO: 307 - protein, 4 aa, artificial sequence
  synthetic
  X (3)..(4): "X" represents that no amino acid is present
FEXX

SEQ ID NO: 308 - protein, 11 aa, artificial sequence
  synthetic
KLEDLKNVFPP

SEQ ID NO: 309 - protein, 9 aa, artificial sequence
  synthetic
KPTGVGGTP

SEQ ID NO: 310 - protein, 80 aa, artificial sequence
  synthetic
KSVFVMKNGTNVACLVKEFYPKDIRINLVSSKKITEFDPAIVISPSGKYNAVKLGKYEDSNSVTCSVQHDNKTVHSTDFE

SEQ ID NO: 311 - protein, 109 aa, artificial sequence
  synthetic
FPSLAPPIMLLVDGKQQMVVVCLVLDVAPPGLDSPIWFSAGQGSALDAFTCGPSPATDGTWTNLAHLSLPSEELASWEPLVCHTGPGAEGHSRSTQPMHLSGEASTART

SEQ ID NO: 312 - protein, 109 aa, artificial sequence
  synthetic
FPSLCPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 313 - protein, 109 aa, artificial sequence
  synthetic
FPCLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 314 - protein, 109 aa, artificial sequence
  synthetic
FPSLAPPIMLLVDGKQQMVVVCLVLDVAPPGLDSPIWFSAGQGSALDAFTYGPCPATDGTWTNLAHLSLPSEELASWEPLVCHTGPGAEGHSRSTQPMHLSGEASTART

SEQ ID NO: 315 - protein, 109 aa, artificial sequence
  synthetic
FPSLAPPIMLLVDGKQQMVVVCLVLDVAPPGLDSPIWFSAGQGSALDAFTYGPSPACDGTWTNLAHLSLPSEELASWEPLVCHTGPGAEGHSRSTQPMHLSGEASTART

SEQ ID NO: 316 - protein, 109 aa, artificial sequence
  synthetic
FPSLAPPCMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTART

SEQ ID NO: 317 - protein, 121 aa, artificial sequence
  synthetic
FPSLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTARTCPQEPLRGTPGG

SEQ ID NO: 318 - protein, 110 aa, artificial sequence
  synthetic
FPSLAPPIMLLVDGKQQMVVVCLVLDVAPPGLDSPIWFSAGQGSALDAFTYGPSPATDGTWTNLAHLSLPSEELASWEPLVCHTGPGAEGHSRSTQPMHLSGEASTARTC

SEQ ID NO: 319 - protein, 116 aa, artificial sequence
  synthetic
EVAVFEPSEAEISHTQKATLVCLATGFYPDHVELSWWVNGKEVHSGVSTDPQPLKEQPALQDSRYALCSRLRVSATFWQNPRNHFRCQVQFYGLSENDEWTQDRAKPVTQIVSAEA

SEQ ID NO: 320 - protein, 116 aa, artificial sequence
  synthetic
EVAVCEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA

SEQ ID NO: 321 - protein, 116 aa, artificial sequence
  synthetic
EVAVFEPCEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA

SEQ ID NO: 322 - protein, 116 aa, artificial sequence
  synthetic
EVAVFEPSECEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA

SEQ ID NO: 323 - protein, 116 aa, artificial sequence
  synthetic
EVAVFEPSEACISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA

SEQ ID NO: 324 - protein, 116 aa, artificial sequence
  synthetic
EVCVFEPSEAEISHTQKATLVCLATGFYPDHVELSWWVNGKEVHSGVSTDPQPLKEQPALQDSRYALSSRLRVSATFWQNPRNHFRCQVQFYGLSENDEWTQDRAKPVTQIVSAEA

SEQ ID NO: 325 - protein, 79 aa, artificial sequence
  synthetic
SVFVMKCGTNVACLVKEFYPKDIRINLVSSKKITEFDPAIVISPSGKYNAVKLGKYEDSNSVTCSVQHDQKTVHSTDFE

SEQ ID NO: 326 - protein, 79 aa, artificial sequence
  synthetic
SVFVMKQGTNVACLVKEFYPKDIRINLVSSKKITEFDPAICISPSGKYNAVKLGKYEDSNSVTCSVQHDQKTVHSTDFE

SEQ ID NO: 327 - protein, 79 aa, artificial sequence
  synthetic
SVFVMKQGTNVACLVKEFYPKDIRINLVSSKKITEFCPAIVISPSGKYNAVKLGKYEDSNSVTCSVQHDQKTVHSTDFE

SEQ ID NO: 328 - protein, 79 aa, artificial sequence
  synthetic
SVCVMKQGTNVACLVKEFYPKDIRINLVSSKKITEFDPAIVISPSGKYNAVKLGKYEDSNSVTCSVQHDQKTVHSTDFE

SEQ ID NO: 329 - protein, 79 aa, artificial sequence
  synthetic
SVFVCKQGTNVACLVKEFYPKDIRINLVSSKKITEFDPAIVISPSGKYNAVKLGKYEDSNSVTCSVQHDQKTVHSTDFE

SEQ ID NO: 330 - protein, 79 aa, artificial sequence
  synthetic
SVFVMKQGTNVACLVKEFYPKDIRINLVSSKKITEFDPAIVISPSGKYNAVKLGKYEDSNSVTCSVQHDQKTVHSTDCE

SEQ ID NO: 331 - protein, 79 aa, artificial sequence
  synthetic
SVFVMKQGTNVACLVKEFYPKDIRINLVSSKKITEFDPAIVISPSGKYNAVKLGKYEDSNSVTCSVQHDQKTVHSTDFC

SEQ ID NO: 332 - protein, 77 aa, artificial sequence
  synthetic
SVFVMKQGTNVACLVKEFYPKDIRINLVSSKKITEFDPAICISPSGKYNAVKLGKYEDSNSVTCSVQHDQKTVHSTD

SEQ ID NO: 333 - protein, 95 aa, artificial sequence
  synthetic
KPCIFLPSIAETKLQKAGTYLCLLEKFFPDVIKIHWQEKKSNTILGSQEGNTMKTQDTYMKFSWLTVPEESLDKEHRCIVRHENNKNGVDQEIIF

SEQ ID NO: 334 - protein, 95 aa, artificial sequence
  synthetic
KPTIFLPSIAETKLQKAGTYLCLLEKFFPDVIKIHWQEKKSNTILGSCEGNTMKTQDTYMKFSWLTVPEESLDKEHRCIVRHENNKNGVDQEIIF

SEQ ID NO: 335 - protein, 95 aa, artificial sequence
  synthetic
KPTIFLPSIAETKLQKAGTYLCLLEKFFPDVIKIHWQEKKSNTILGSQEGNTCKTQDTYMKFSWLTVPEESLDKEHRCIVRHENNKNGVDQEIIF

SEQ ID NO: 336 - protein, 95 aa, artificial sequence
  synthetic
KPTIFLPCIAETKLQKAGTYLCLLEKFFPDVIKIHWQEKKSNTILGSQEGNTMKTQDTYMKFSWLTVPEESLDKEHRCIVRHENNKNGVDQEIIF

SEQ ID NO: 337 - protein, 95 aa, artificial sequence
  synthetic
KPTICLPSIAETKLQKAGTYLCLLEKFFPDVIKIHWQEKKSNTILGSQEGNTMKTQDTYMKFSWLTVPEESLDKEHRCIVRHENNKNGVDQEIIF

SEQ ID NO: 338 - protein, 95 aa, artificial sequence
  synthetic
KPTIFLPSIACTKLQKAGTYLCLLEKFFPDVIKIHWQEKKSNTILGSQEGNTMKTQDTYMKFSWLTVPEESLDKEHRCIVRHENNKNGVDQEIIF

SEQ ID NO: 339 - protein, 95 aa, artificial sequence
  synthetic
KPTIFLPSICETKLQKAGTYLCLLEKFFPDVIKIHWQEKKSNTILGSQEGNTMKTQDTYMKFSWLTVPEESLDKEHRCIVRHENNKNGVDQEIIF

SEQ ID NO: 340 - protein, 106 aa, artificial sequence
  synthetic
KPTIFLPSIAETKLQKAGTYLCLLEKFFPDVIKIHWQEKKSNTILGSCEGNTMKTQDTYMKFSWLTVPEESLDKEHRCIVRHENNKNGVDQEIIFPPIKTDVITMD

SEQ ID NO: 341 - protein, 11 aa, artificial sequence
  synthetic
EPKSCDKTHTC

SEQ ID NO: 342 - protein, 10 aa, Mus musculus
GFAFTDYYIH

SEQ ID NO: 343 - protein, 17 aa, Mus musculus
WISPGNVNTKYNENFKG

SEQ ID NO: 344 - protein, 10 aa, Mus musculus
DGYSLYYFDY

SEQ ID NO: 345 - protein, 17 aa, Mus musculus
KSSQSLLNSRTRKNYLA

SEQ ID NO: 346 - protein, 7 aa, Mus musculus
WASTRQS

SEQ ID NO: 347 - protein, 8 aa, Mus musculus
TQSHTLRT

SEQ ID NO: 348 - protein, 119 aa, Mus musculus
QVQLQQSGPELVKPGASVRISCKASGFAFTDYYIHWVKQRPGQGLEWIGWISPGNVNTKYNENFKGRATLTADLSSSTAYMQLSSLTSEDSAVYFCARDGYSLYYFDYWGQGTTLTVSS

SEQ ID NO: 349 - DNA, 357 bp, Mus musculus
caggtccagctgcagcagtctggacctgaattggtgaagcctggggcttccgtgaggatatcctgcaaggcttctggcttcgccttcacagactactatatacactgggtgaagcagaggcctggacagggtcttgagtggattggatggatttctcctggaaatgttaatactaaatacaatgaaaacttcaagggcagggccacactgactgcagacctatcctccagcacagcctacatgcagctcagcagcctgacctctgaggactctgcggtctatttctgtgcaagagatggatattccctgtattactttgactactggggccaaggcaccactctcacagtctcctca

SEQ ID NO: 350 - protein, 112 aa, Mus musculus
DIVMSQSPSSLTVSAGEKVTMSCKSSQSLLNSRTRKNYLAWYQQKPGQSPKLLIYWASTRQSGVPDRFTGSGSGTAFTLTISGVQAEDLAVYFCTQSHTLRTFGGGTKLEIK

SEQ ID NO: 351 - DNA, 336 bp, Mus musculus
gacattgtgatgtcacagtctccatcctccctgactgtgtcagcaggagagaaggtcactatgagctgcaaatccagtcagagtctgctcaacagtagaacccgaaagaactacttggcttggtaccagcagaagccagggcagtctcctaaactactaatctactgggcatccactaggcaatctggggtccctgatcgcttcacaggcagtggatctgggacagctttcactctcaccatcagcggtgtgcaggctgaagacctggcagtttatttctgcacgcaatctcatactcttcggacgttcggtggaggcaccaagctggaaatcaaa

SEQ ID NO: 352 - protein, 119 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVSS

SEQ ID NO: 353 - DNA, 357 bp, artificial sequence
  synthetic
caggtgcagcttgtgcagtctggggcagaagtgaagaagcctgggtctagtgtcaaggtgtcatgcaaggctagcgggttcgcctttactgactactacatccactgggtgcggcaggctcccggacaagggttggagtggatgggatggatctccccaggcaatgtcaacacaaagtacaacgagaacttcaaaggccgcgtcaccattaccgccgacaagagcacctccacagcctacatggagctgtccagcctcagaagcgaggacactgccgtctactactgtgccagggatgggtactccctgtattactttgattactggggccagggcacactggtgacagtgagctcc

SEQ ID NO: 354 - protein, 112 aa, artificial sequence
  synthetic
DIVMTQSPDSLAVSLGERATINCKSSQSLLNSRTRKNYLAWYQQKPGQPPKLLIYWASTRQSGVPDRFSGSGSGTDFTLTISSLQAEDVAVYYCTQSHTLRTFGGGTKVEIK

SEQ ID NO: 355 - DNA, 336 bp, artificial sequence
  synthetic
gatatcgtgatgacccagagcccagactcccttgctgtctccctcggcgaaagagcaaccatcaactgcaagagctcccaaagcctgctgaactccaggaccaggaagaattacctggcctggtatcagcagaagcccggccagcctcctaagctgctcatctactgggcctccacccggcagtctggggtgcccgatcggtttagtggatctgggagcgggacagacttcacattgacaattagctcactgcaggccgaggacgtggccgtctactactgtactcagagccacactctccgcacattcggcggagggactaaagtggagattaag

SEQ ID NO: 356 - protein, 10 aa, Mus musculus
GYTFTNYVIH

SEQ ID NO: 357 - protein, 17 aa, Mus musculus
YFNPYNDGTEYNEKFKA

SEQ ID NO: 358 - protein, 12 aa, Mus musculus
GPYYYGSSPFDY

SEQ ID NO: 359 - protein, 17 aa, artificial sequence
  synthetic
YIDPYNADTTYNQKFKG

SEQ ID NO: 360 - protein, 10 aa, Mus musculus
SASSTVNYMH

SEQ ID NO: 361 - protein, 7 aa, Mus musculus
STSNLAS

SEQ ID NO: 362 - protein, 9 aa, Mus musculus
HQWSSYPYT

SEQ ID NO: 363 - protein, 116 aa, Mus musculus
EIQLQQSGPELVKPGASVKVSCKASGYAFTSYNMYWVKQSHGKSLEWIGYIDPYNGDTTYNQKFKGKATLTVDKSSSTAYMHLNSLTSEDSAVYYCLTTAYAMDYWGQGTSVTVSS

SEQ ID NO: 364 - DNA, 348 bp, Mus musculus
gagatccagctgcagcagtctggacctgagctggtgaagcctggggcttcagtgaaggtatcctgcaaggcttctggttatgcattcactagctacaacatgtactgggtgaagcagagccatggaaagagccttgagtggattggatatattgatccttacaatggtgatactacctacaaccagaagttcaagggcaaggccacattgactgttgacaagtcctccagcacagcctacatgcatctcaacagcctgacatctgaggactctgcagtctattactgtctcactacggcctatgctatggactactggggtcaaggaacctcagtcaccgtctcctca

SEQ ID NO: 365 - protein, 106 aa, Mus musculus
QIVLTQSPAIMSASLGEEITLTCSASSTVNYMHWYQQKSGTSPKLLIYSTSNLASGVPSRFSGSGSGTFYSLTIRSVEAEDAADYYCHQWSSYPYTFGGGTKLEIK

SEQ ID NO: 366 - DNA, 318 bp, Mus musculus
caaattgttctcacccagtctccagcaatcatgtctgcatctctaggggaggagatcaccctaacctgcagtgccagctcgactgtaaattacatgcactggtaccagcagaagtcaggcacttctcccaaactcttgatttatagcacatccaacctggcttctggagtcccttctcgcttcagtggcagtgggtctgggaccttttattctctcacaatcagaagtgtggaggctgaagatgctgccgattattactgccatcagtggagtagttatccgtacacgttcggaggggggaccaagctggaaataaaa

SEQ ID NO: 367 - protein, 116 aa, artificial sequence
  synthetic
QMQLVQSGPEVKKPGTSVKVSCKASGYAFTSYNMYWVRQARGQRLEWIGYIDPYNADTTYNQKFKGRVTITRDMSTSTAYMELSSLRSEDTAVYYCLTTAYAMDYWGQGTLVTVSS

SEQ ID NO: 368 - DNA, 348 bp, artificial sequence
  synthetic
caaatgcagctcgtccagtctggacctgaagtgaagaagcccgggacatccgtcaaggtctcatgtaaggctagcgggtacgcattcacttcctacaacatgtactgggtgcgccaggccagaggacagaggttggagtggatcggctacatcgacccatacaacgccgatactacctacaatcagaagtttaaagggcgggtgaccattacccgggatatgtccacctccaccgcctacatggagctgagcagcctgaggagcgaggacacagccgtgtactactgcctgacaacagcctatgccatggactattggggccagggcacacttgtgactgtgagcagt

SEQ ID NO: 369 - protein, 106 aa, artificial sequence
  synthetic
DIQLTQSPSFLSASVGDRVTITCSASSTVNYMHWYQQKPGKAPKLLIYSTSNLASGVPSRFSGSGSGTEFTLTISSLQPEDFATYYCHQWSSYPYTFGQGTKLEIK

SEQ ID NO: 370 - DNA, 318 bp, artificial sequence
  synthetic
gacatccagctcacccaatccccttctttcctctccgcaagtgtcggagatagggtgactatcacctgctcagcttcttcaaccgtgaactacatgcattggtaccagcagaagcccgggaaagccccaaagctgctgatctacagcacctccaatctggccagtggagtgccaagccggtttagcgggagcggctccggcactgaattcactttgacaattagcagccttcagcctgaggactttgccacatattactgtcaccagtggtccagctacccctacacattcgggcagggcacaaagctggagattaag

SEQ ID NO: 371 - protein, 213 aa, artificial sequence; identical to SEQ ID NO: 23
  synthetic

SEQ ID NO: 372 - protein, 446 aa, artificial sequence
  synthetic
QMQLVQSGPEVKKPGTSVKVSCKASGYAFTSYNMYWVRQARGQRLEWIGYIDPYNGDTTYNQKFKGRVTITRDMSTSTAYMELSSLRSEDTAVYYCLTTAYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 373 - protein, 207 aa, artificial sequence; identical to SEQ ID NO: 12
  synthetic

SEQ ID NO: 374 - protein, 475 aa, artificial sequence
  synthetic
QVQLVQSGAEVKKPGSSVKVSCKASGFAFTDYYIHWVRQAPGQGLEWMGWISPGNVNTKYNENFKGRVTITADKSTSTAYMELSSLRSEDTAVYYCARDGYSLYYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRASDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 375 - protein, 215 aa, artificial sequence
  synthetic
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 376 - protein, 710 aa, artificial sequence
  synthetic
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSGGGGSEVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGR

SEQ ID NO: 377 - protein, 200 aa, artificial sequence
  synthetic
SYELTQPLSVSVALGQTARITCGGDNIGNKDVHWYQQKPGQAPVLVIYRDSNRPSGIPEGFSGSNSGNTATLTISRAQAGDEADYYCQVWDSIWVFGGGTKLTVLPDIQNPDPAVYQLRDSKSSDKSVCLFTDFDSQTQVSQSKDSDVYITDKCVLDMRSMDFKSNSAVAWSQKSDFACANAFQNSIIPEDTFFPSPESS

SEQ ID NO: 378 - protein, 211 aa, artificial sequence
  synthetic
SYELTQPLSVSVALGQTARITCGGDNIGNKDVHWYQQKPGQAPVLVIYRDSNRPSGIPEGFSGSNSGNTATLTISRAQAGDEADYYCQVWDSIWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 379 - protein, 710 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSGGGGSQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGR

SEQ ID NO: 380 - protein, 203 aa, artificial sequence
  synthetic
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKPDIQNPDPAVYQLRDSKSSDKSVCLFTDFDSQTQVSQSKDSDVYITDKCVLDMRSMDFKSNSAVAWSQKSDFACANAFQNSIIPEDTFFPSPESS

SEQ ID NO: 381 - protein, 200 aa, artificial sequence; identical to SEQ ID NO: 377
  synthetic

SEQ ID NO: 382 - protein, 707 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSGGGGSQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 383 - protein, 215 aa, artificial sequence; identical to SEQ ID NO: 375
  synthetic

SEQ ID NO: 384 - protein, 200 aa, artificial sequence; identical to SEQ ID NO: 377
  synthetic

SEQ ID NO: 385 - protein, 701 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRGGGGSGGGGSQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 386 - protein, 215 aa, artificial sequence; identical to SEQ ID NO: 375
  synthetic

SEQ ID NO: 387 - protein, 211 aa, artificial sequence; identical to SEQ ID NO: 378
  synthetic

SEQ ID NO: 388 - protein, 698 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVGGGGSGGGGSQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 389 - protein, 203 aa, artificial sequence; identical to SEQ ID NO: 380
  synthetic

SEQ ID NO: 390 - protein, 200 aa, artificial sequence; identical to SEQ ID NO: 377
  synthetic

SEQ ID NO: 391 - protein, 475 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRGGGGSGGGGSDIVMTQTPLSLSVTPGQPASISCRSSQSLLNSDGNTYLYWYLQKPGQSPQLLIYLVSKLGSGVPNRFSGSGSGTDFTLKISRVEAEDVGVYYCVQGTHDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 392 - protein, 447 aa, artificial sequence
  synthetic
QVQLQESGPGLVKPSETLSLTCSVTYHTITSGYDWTWIRKPPGKGMEWIGYISYSGNTNYNPSLKSRVTISRDTSKNQFFLKLSSVTAADTAVYYCASMMVPHYYVMDAWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 393 - protein, 211 aa, artificial sequence; identical to SEQ ID NO: 378
  synthetic

SEQ ID NO: 394 - protein, 711 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSGGGGSQVQLVQSGAEVKKPGSSVKVSCKASGYTFTNYFMNWVRQAPGQGLEWMGRVDPEQGRADYAEKFKKRVTITADKSTSTAYMELSSLRSEDTAVYYCARRAMDNYGFAYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGR

SEQ ID NO: 395 - protein, 201 aa, artificial sequence
  synthetic
EIVLTQSPDFQSVTPKEKVTITCSANSALSYMYWYQQKPDQSPKLWVHGTSNLASGVPSRFSGSGSGTDFTLTINSLEAEDAATYYCHHWSNTQWTFGGGTKVEIKPDIQNPDPAVYQLRDSKSSDKSVCLFTDFDSQTQVSQSKDSDVYITDKCVLDMRSMDFKSNSAVAWSQKSDFACANAFQNSIIPEDTFFPSPESS

SEQ ID NO: 396 - protein, 200 aa, artificial sequence; identical to SEQ ID NO: 377
  synthetic

SEQ ID NO: 397 - protein, 708 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSGGGGSQVQLVQSGAEVKKPGSSVKVSCKASGYTFTNYFMNWVRQAPGQGLEWMGRVDPEQGRADYAEKFKKRVTITADKSTSTAYMELSSLRSEDTAVYYCARRAMDNYGFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 398 - protein, 213 aa, artificial sequence
  synthetic
EIVLTQSPDFQSVTPKEKVTITCSANSALSYMYWYQQKPDQSPKLWVHGTSNLASGVPSRFSGSGSGTDFTLTINSLEAEDAATYYCHHWSNTQWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 399 - protein, 200 aa, artificial sequence; identical to SEQ ID NO: 377
  synthetic

SEQ ID NO: 400 - protein, 702 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRGGGGSGGGGSQVQLVQSGAEVKKPGSSVKVSCKASGYTFTNYFMNWVRQAPGQGLEWMGRVDPEQGRADYAEKFKKRVTITADKSTSTAYMELSSLRSEDTAVYYCARRAMDNYGFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 401 - protein, 213 aa, artificial sequence; identical to SEQ ID NO: 398
  synthetic

SEQ ID NO: 402 - protein, 211 aa, artificial sequence; identical to SEQ ID NO: 378
  synthetic

SEQ ID NO: 403 - protein, 699 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVGGGGSGGGGSQVQLVQSGAEVKKPGSSVKVSCKASGYTFTNYFMNWVRQAPGQGLEWMGRVDPEQGRADYAEKFKKRVTITADKSTSTAYMELSSLRSEDTAVYYCARRAMDNYGFAYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 404 - protein, 201 aa, artificial sequence; identical to SEQ ID NO: 395
  synthetic

SEQ ID NO: 405 - protein, 667 aa, artificial sequence
  synthetic
QVQLQESGPGLVKPSETLSLTCSVTYHTITSGYDWTWIRKPPGKGMEWIGYISYSGNTNYNPSLKSRVTISRDTSKNQFFLKLSSVTAADTAVYYCASMMVPHYYVMDAWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSGGGGSGGGGSGGGGSSYELTQPLSVSVALGQTARITCGGDNIGNKDVHWYQQKPGQAPVLVIYRDSNRPSGIPEGFSGSNSGNTATLTISRAQAGDEADYYCQVWDSIWVFGGGTKLTVLPDIQNPDPAVYQLRDSKSSDKSVCLFTDFDSQTQVSQSKDSDVYITDKCVLDMRSMDFKSNSAVAWSQKSDFACANAFQNSIIPEDTFFPSPESS

SEQ ID NO: 406 - protein, 246 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGR

SEQ ID NO: 407 - protein, 219 aa, artificial sequence
  synthetic
DIVMTQTPLSLSVTPGQPASISCRSSQSLLNSDGNTYLYWYLQKPGQSPQLLIYLVSKLGSGVPNRFSGSGSGTDFTLKISRVEAEDVGVYYCVQGTHDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 408 - protein, 428 aa, artificial sequence
  synthetic
QVQLQESGPGLVKPSETLSLTCSVTYHTITSGYDWTWIRKPPGKGMEWIGYISYSGNTNYNPSLKSRVTISRDTSKNQFFLKLSSVTAADTAVYYCASMMVPHYYVMDAWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVGGGGSGGGGSSYELTQPLSVSVALGQTARITCGGDNIGNKDVHWYQQKPGQAPVLVIYRDSNRPSGIPEGFSGSNSGNTATLTISRAQAGDEADYYCQVWDSIWVFGGGTKLTVLPDIQNPDPAVYQLRDSKSSDKSVCLFTDFDSQTQVSQSKDSDVYITDKCVLDMRSMDFKSNSAVAWSQKSDFACANAFQNSIIPEDTFFPSPESS

SEQ ID NO: 409 - protein, 471 aa, artificial sequence
  synthetic
EVQLLESGGGLVQPGGSLRLSCAASGFTFSSHAMSWVRQAPGKGLEWVSTITGGGGSIYYADSVKGRFTISRDNSKNTLYLQMNSLRAEDTAVYYCAKNRAGEGYFDYWGQGTLVTVLEDLKNVFPPEVAVFEPSEAEISHTQKATLVCLATGFYPDHVELSWWVNGKEVHSGVCTDPQPLKEQPALQDSRYALSSRLRVSATFWQNPRNHFRCQVQFYGLSENDEWTQDRAKPVTQIVSAEAWGRYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 410 - protein, 219 aa, artificial sequence; identical to SEQ ID NO: 407
  synthetic

SEQ ID NO: 411 - protein, 95 aa, artificial sequence; identical to SEQ ID NO: 241
  synthetic

What is claimed:

1. A polypeptide complex comprising:

a first polypeptide comprising, from N-terminus to C-terminus, a first heavy chain variable domain (VH) of a first antibody operably linked to a first T cell receptor (TCR) constant region (C1), and a second polypeptide comprising, from N-terminus to C-terminus, a first light chain variable domain (VL) of the first antibody operably linked to a second TCR constant region (C2), wherein:

C1 and C2 are capable of forming a dimer comprising at least one non-native interchain bond between C1 and C2, and the non-native interchain bond is capable of stabilizing the dimer, C1 comprises an engineered CBeta, and C2 comprises an engineered CAlpha, the first VH is operably linked to C1 at a first conjunction domain, and the first VL is operably linked to C2 at a second conjunction domain, wherein the first conjunction domain comprises or is SEQ ID NO: 49 or 50, and the second conjunction domain comprises or is SEQ ID NO: 51 or 52, and the first antibody has a first antigenic specificity, wherein: the polypeptide complex is not a bispecific polypeptide complex comprising a 1st antigen-binding moiety associated with a 2nd antigen-binding moiety, wherein:

the 1st antigen-binding moiety comprising:

a 1st polypeptide comprising, from N-terminus to C-terminus, a 1st heavy chain variable domain (VH) of a 1st antibody operably linked to a 1st T cell receptor (TCR) constant region (C1'), and a 2nd polypeptide comprising, from N-terminus to C-terminus, a 1st light chain variable domain (VL) of the 1st antibody operably linked to a 2nd TCR constant region (C2'), wherein:

C1' comprises an engineered CBeta comprising SEQ ID NO: 34 and C2' comprises an engineered CAlpha comprising SEQ ID NO: 44 the 2nd antigen-binding moiety comprising:

a 2nd VH of a 2nd antibody operably linked to an antibody heavy chain CH1 domain, and a 2nd VL of the 2nd antibody operably linked to an antibody light chain constant (CL) domain, wherein:

the 1st VH is operably linked to C1' at a 1st conjunction domain, and the 1st VL is operably linked to C2' at a 2nd conjunction domain, wherein the 1st conjunction domain comprises or is SEQ ID NO: 50, and the 2nd conjunction domain comprises or is SEQ ID NO: 52, wherein:

one of the 1st and the 2nd antigen-binding moiety is an anti-CD3 binding moiety, and the other one is an anti-CD19 binding moiety, wherein: the anti-CD3 binding moiety is derived from an anti-CD3 antibody comprising:

a) a heavy chain CDR1 comprising SEQ ID NO: 342, b) a heavy chain CDR2 comprising SEQ ID NO: 343, c) a heavy chain CDR3 comprising SEQ ID NO: 344, d) a kappa light chain CDR1 comprising SEQ ID NO: 345, e) a kappa light chain CDR2 comprising SEQ ID NO: 346, and f) a kappa light chain CDR3 comprising SEQ ID NO: 347; and the anti-CD19 binding moiety is derived from an anti-CD19 antibody comprising:

a) a heavy chain CDR1 comprising SEQ ID NO: 356, b) a heavy chain CDR2 comprising SEQ ID NO: 359, c) a heavy chain CDR3 comprising SEQ ID NO: 358, d) a kappa light chain CDR1 comprising SEQ ID NO: 360, e) a kappa light chain CDR2 comprising SEQ ID NO: 361, and f) a kappa light chain CDR3 comprising SEQ ID NO: 362.

2. The polypeptide complex of claim 1, wherein the engineered CBeta and the engineered CAlpha comprise a pair of mutated cysteine residues that substitute for a pair of amino acid residues selected from the group consisting of: S56C in CBeta and T49C in Calpha, S16C in CBeta and Y11C in CAlpha, F13C in CBeta and L13C in CAlpha, S16C in CBeta and L13C in CAlpha, V12C in CBeta and S16C in CAlpha, E14C in CBeta and S16C in CAlpha, F13C in CBeta and V23C in CAlpha, L62C in CBeta and Y44C in CAlpha, D58C in CBeta and T46C in CAlpha, S76C in CBeta and T46C in CAlpha, S56C in CBeta and L51C in CAlpha, S56C in CBeta and S62C in CAlpha, and R78C in CBeta and S62C in CAlpha, and wherein the pair of cysteine residues are capable of forming a non-native interchain disulphide bond, and wherein the native cysteine residue at position C74 of engineered CBeta is absent, and wherein the native CBeta comprises any one of SEQ ID NOs: 256 and 257, and the native CAlpha comprises SEQ ID NO: 254.

3. The polypeptide complex of claim 1, wherein at least one native glycosylation site is absent in the engineered CBeta and/or in the engineered CAlpha, wherein the native glycosylation site in the engineered CBeta is N69, and/or the native glycosylation site(s) in the engineered CAlpha is/are selected from N34, N68, N79, and any combination thereof, wherein the native CBeta comprises any one of SEQ ID NOs: 256 and 257, and the native CAlpha comprises SEQ ID NO: 254.

4. The polypeptide complex of claim 1, wherein the engineered CBeta retains an FG loop encompassing the amino acid residues 101-117 of the native CBeta and/or a DE loop encompassing the amino acid residues 66-71 of the native CBeta, wherein the native CBeta comprises any one of SEQ ID NOs: 256 and 257.

5. The polypeptide complex of claim 1, wherein the engineered CAlpha comprises SEQ ID NO: 43-48, and/or the engineered CBeta comprises SEQ ID NO: 33-41.

6. The polypeptide complex of claim 1, wherein the engineered CBeta lacks an FG loop encompassing the amino acid residues 101-117 of the native CBeta and/or a DE loop at position encompassing the amino acid residues 66-71 of the native CBeta, wherein the native CBeta comprises any one of SEQ ID NOs: 256 and 257.

7. A conjugate comprising the polypeptide complex of claim 1, conjugated to a moiety.

8. An isolated polynucleotide encoding the polypeptide complex of claim 1, or an isolated vector comprising the polynucleotide.

9. A host cell comprising the isolated polynucleotide or the isolated vector of claim 8.

10. A method of producing the polypeptide complex of claim 1, comprising:

a) introducing to a host cell:

a first polynucleotide encoding a first polypeptide comprising, from N-terminus to C-terminus, a first heavy chain variable region (VH) of a first antibody operably linked to a first TCR constant region (C1), and a second polynucleotide encoding a second polypeptide comprising, from N-terminus to C-terminus, a first light chain variable domain (VL) of the first antibody operably linked to a second TCR constant region (C2), wherein:

C1 and C2 are capable of forming a dimer comprising at least one non-native interchain bond between C1 and C2, and the non-native interchain bond is capable of stabilizing the dimer,

C1 comprises an engineered CBeta, and C2 comprises an engineered CAlpha, the first VH is operably linked to C1 at a first conjunction domain, and the first VL is operably linked to C2 at a second conjunction domain, wherein the first conjunction domain comprises or is SEQ ID NO: 49 or 50, and the second conjunction domain comprises or is SEQ ID NO: 51 or 52, and the first antibody has a first antigen-binding moiety, wherein:

the polypeptide complex is not a bispecific polypeptide complex comprising a 1st antigen-binding moiety associated with a 2nd antigen-binding moiety, wherein:

the 1st antigen-binding moiety comprising:
- a 1st polypeptide comprising, from N-terminus to C-terminus, a 1st heavy chain variable domain (VH) of a 1st antibody operably linked to a 1st T cell receptor (TCR) constant region (C1'), and
- a 2nd polypeptide comprising, from N-terminus to C-terminus, a 1st light chain variable domain (VL) of the 1st antibody operably linked to a 2nd TCR constant region (C2'), wherein:
C1' comprises an engineered CBeta comprising SEQ ID NO: 34 and C2' comprises an engineered CAlpha comprising SEQ ID NO: 44, the 2nd antigen-binding moiety comprising:
- a 2nd VH of a 2nd antibody operably linked to an antibody heavy chain CH1 domain, and
- a 2nd VL of the 2nd antibody operably linked to an antibody light chain constant (CL) domain, wherein:
the 1st VH is operably linked to C1' at a 1st conjunction domain, and
the 1st VL is operably linked to C2' at a 2nd conjunction domain,
wherein the 1st conjunction domain comprises or is SEQ ID NO: 50, and
the 2nd conjunction domain comprises or is SEQ ID NO: 52, wherein:
one of the 1st and the 2nd antigen-binding moiety is an anti-CD3 binding moiety, and the other one is an anti-CD19 binding moiety, wherein: the anti-CD3 binding moiety is derived from an anti-CD3 antibody comprising:
a) a heavy chain CDR1 comprising SEQ ID NO: 342, b) a heavy chain CDR2 comprising SEQ ID NO: 343, c) a heavy chain CDR3 comprising SEQ ID NO: 344, d) a kappa light chain CDR1 comprising SEQ ID NO: 345, e) a kappa light chain CDR2 comprising SEQ ID NO: 346, and f) a kappa light chain CDR3 comprising SEQ ID NO: 347; and the anti-CD19 binding moiety is derived from an anti-CD19 antibody comprising:
a) a heavy chain CDR1 comprising SEQ ID NO: 356, b) a heavy chain CDR2 comprising SEQ ID NO: 359, c) a heavy chain CDR3 comprising SEQ ID NO: 358, d) a kappa light chain CDR1 comprising SEQ ID NO: 360, e) a kappa light chain CDR2 comprising SEQ ID NO: 361, and f) a kappa light chain CDR3 comprising SEQ ID NO: 362, and b) allowing the host cell to express the polypeptide complex.

11. The polypeptide complex of claim 2, wherein the engineered CBeta and the engineered CAlpha comprise a pair of mutated cysteine residues: S56C in CBeta and T49C in Calpha.

12. The polypeptide complex of claim 3, wherein the engineered CBeta and the engineered CAlpha comprise a pair of mutated cysteine residues: S56C in CBeta and T49C in Calpha.

13. The polypeptide complex of claim 12, wherein the native glycosylation site N69 in the engineered CBeta is absent, and the native glycosylation sites N34, N68, and N79 in the engineered CAlpha are absent.

14. The polypeptide complex of claim 4, wherein the engineered CBeta and the engineered CAlpha comprise a pair of mutated cysteine residues: S56C in CBeta and T49C in Calpha, wherein the native CAlpha comprises SEQ ID NO: 254.

15. The polypeptide complex of claim 14, wherein engineered CBeta retains an FG loop encompassing the amino acid residues 101-117 of the native CBeta and a DE loop encompassing the amino acid residues 66-71 of the native CBeta.

16. The polypeptide complex of claim 6, wherein the engineered CBeta and the engineered CAlpha comprise a pair of mutated cysteine residues: S56C in CBeta and T49C in Calpha, wherein the native CAlpha comprises SEQ ID NO: 254.

17. The polypeptide complex of claim 16, wherein the engineered CBeta lacks an FG loop encompassing the amino acid residues 101-117 of the native CBeta and a DE loop at position encompassing the amino acid residues 66-71 of the native CBeta.

18. The polypeptide complex of claim 1, wherein the engineered CAlpha comprises SEQ ID NO: 43, and the engineered CBeta comprises SEQ ID NO: 33.

19. The polypeptide complex of claim 1, wherein the engineered CAlpha comprises SEQ ID NO: 43, and the engineered CBeta comprises SEQ ID NO: 37.

20. The polypeptide complex of claim 1, wherein the engineered CAlpha comprises SEQ ID NO: 43, and the engineered CBeta comprises SEQ ID NO: 41.

21. The polypeptide complex of claim 1, wherein the engineered CAlpha comprises SEQ ID NO: 43, or the engineered CBeta comprises SEQ ID NO: 33.

22. The polypeptide complex of claim 1, wherein the engineered CAlpha comprises SEQ ID NO: 43, or the engineered CBeta comprises SEQ ID NO: 37.

23. The polypeptide complex of claim 1, wherein the engineered CAlpha comprises SEQ ID NO: 43, or the engineered CBeta comprises SEQ ID NO: 41.

24. The polypeptide complex of claim 11, wherein the first conjunction domain comprises or is SEQ ID NO: 50, and the second conjunction domain comprises or is SEQ ID NO: 52.

25. The polypeptide complex of claim 13, wherein the first conjunction domain comprises or is SEQ ID NO: 50, and the second conjunction domain comprises or is SEQ ID NO: 52.

26. The polypeptide complex of claim 18, wherein the first conjunction domain comprises or is SEQ ID NO: 50, and the second conjunction domain comprises or is SEQ ID NO: 52.

27. The polypeptide complex of claim 1, wherein the engineered CAlpha comprises SEQ ID NO: 44, and the engineered CBeta comprises SEQ ID NO: 34.

* * * * *